United States Patent 10,724,096 (METHODS AND COMPOSITIONS FOR INHIBITING AND TREATING NEUROLOGICAL CONDITIONS) - sequence listing, part 83

SEQ ID NO: 1746 - DNA, 430182 bp, Homo sapiens
ctcactcaagactgaaaggatgtctttctatttagaggtcaccaaattaacatctcagaccaatcaaggtaggtgggagtctgcgtgagtcccacggtacaagcctcagtgcgcggccctgcaacccccaccaccccagagagagccgatgctgcaaaatgaaggggaggcccaggaatttctaggtctcttctgagtgaaatgattctagacgctagctggaaagaccttctacacagaaaggaaggaaaccagtgtttattgagcagctgttcttggcaatgattccactgctttctttcaggtatctgctgagtccttccaagagcctggtaaggaagtcattttctctatcttgcagaagataaaataggggctcatattaaactatttactcaagaatactcaagtaggaaggaggcaggtggccctgggctgagtctcttctgaccaccatggtagccattggttactggcactgtgccagggctcccacacactgtcttatttacacgttactttgagatgtataacgggccttgggtctagtcggatccttattcttgactaagaaaggagattccacaaagacccaaaatacagatagaatcccacgaatcccatggctatgttcacgaagggagaggagcaccaacaaagtcaagtcactcaggtgcctcactccccaaatgcgggacgtttcctacagaaaccaagcctgctgctcagtgacagctttccaggaaatgccaattccagaaccaaggtacctgaatcacagtgggaaagaccaaggtgggaagcaaatgcagcaattaaggccaaaaataatcccaatgggtgagccgccggaccagagtcacctctgagagcacggagacaaacagcaagcttggcactcggcattttgaagacaacaacccacacctgaactgctgaagaatgtggcgatgtgggcacttggttaagcacacactgatcgccagcgtgagcacacaatcctcagcagcacggcggcccagatttgccgcccacagcccaacagtgccatctcaggagccacggcccccttggagaaggacggggatgctcttcagaggggacactgccaaactgtgtccaggttaaggggataaagaaggatcctatggcacacagaaatgataccacctgggtgccatggggatgctgaacccgtggcacagaagggaagggagaggtgacagcaaatgctcacagagctgccatgtggaggaaggtgaactggagtgcctgaagggtgagatactgcagggtgggaacatctggcctattatggacagagtttttatcacaacaaagaattgggaaacaagtgagtaagtgacctgtgtgaggagggaactattcgcccaggatctgaacaacatggcagatgcaatctctcacactcttacctcttctcctttctggattctccgactggagctgatgataattttgtgtcctctctcaaaagtcaccacttcagccacacaattaggtgcacacgaatggttgatatacctgcaagccaccatgtcagaaaactgtattgtaaaacagctagaagcagctttaaaaacttcccatttattgataaagcagtttttgctaattaaatttctatttgcccattgttagaagcacaaatataacatttaaataaaaattctcaactcatttgctctgaatgtttagtcaccgccaggctgccgtgagagcctttcccttggcttcagtgttctctccaccagcactggccccacaagcaaaagcactccccgtcaggttcctcgctgtctcaccttgcgggccctcctgtgagcgtcgcgtcaatcacatggtcgttatccatgcggaacatgtacacaccacggttctgagggaaaagtcagtcagtaagtcatcaatgtcgacctgaaactcccctctgtgttcctatccacaccaggaggactcagtcgaaactgaacggaacggcagcctgatcatccttactgtggatattctattaggcacagatgacatttacatggcacgaatggaaagcatggaatcagtaggttgtgtgtgaagccaggctcattaatttacagttgtctatcaaagtaaactgtaacaccaattgaaagagatacaactgataaaaatacactaatatacagatatggcttttgtttaaagctgaatgcagcatgacagatttcattctgccttccagggtgtctggctggcacggagaaagggagaggatgatggtgctgtgtatacaatctcggggaccagacacctacctgagactcataaagcttctctttcctgttggctacttcgtttcgaatgatagtcccgatgtactcaatgaccatggtgtgtttctcaatgtctcgagcagcatacaggcccagcccctaaaaaaaagtgtgtacatacttccaatttatgtgacaacaagtcttttttctgtttttcatacaaaggtttcaccctcgggtcttattagaagccatacttaagtttcacttgaactcaaatcatttttgaatatgctattttctgaaattttaaaaattggacatttttactacttaaaactatgccatcactagcttattcctacatcttttttagcactaaattcttagagtctatgtataaagtagtactgtggcttggctgtcttatgtattaggctatctaaccttccagatgagatagctgagttcccaccaactaaataagcttattgacttgtggtgtttattttaccccaatactatttcaaaaaagacataataaattcaataacatagaaatcaggctaactataaccaatcactgatactgtaaacagggttcagacttggctctgagtttcccagcagccagggcaaagagcagacacaggaaacgtcactctgctgtaaatatcaggaatgttggaaacaaatgaagctcttggggaaggtaaatttttcactaatacaaaattctgaggctgggaaagaagtttgaacgggctgaaatggaagcagctctcactgcgcagcttgtactcccgtgctggtggcctgccaggtgcactattcaggttggtagcacaacttgtagagaaacatactaacaaaatatgggtctttgccataaatagttgtattttcttgtcccaattttgggtttttgcacttaattctgactagaaggcaactgaatgcaaaagtactagactagatgcaactgaatcagaagtactagactagaatgcaattctagaattgaactgaattctagaatgcagaaatcaactgcattctagtcggaattactaggaggaccatgtgctgccccagctgcatcctcatgaagcacatccgggagcacatggtgggaagggccatgtgagagactttagtatgtgaactgatttatcctctgaacaagcatctttgattatctgttctactccagatacaactcacaagtgaatgaaccagaacacacaaaaagtatgtatggagatcaatagagtgtggtttaagaataaacaagatcagtggaaatgaagagattccaaatgggccaggcgtggtgactcatgcctataatcccaccactttgggaagccaaggcaggcagatcccttgaggtcaggagttcaagaccagcctggccaacatggtgaaaccccgtctctactaaaaatacaaaaattagctgggcatggtggcgtgtgcctgtaattccagctactagggaggctgagccaagagaattgcttgagccccagaggcagaggttgcagtgagctgagatcatgccactgcactccagcctgggcaacagagtgagactccagaggctgaggcatgagaatcgctttaatctgggagccaagatggcaccactgcactccagtctgggtgacagagtgagactccatctcagaaaagagaaatagatccctgcatgtatgaaaatctaacgtacagtagtaactggtattaaaattcagtttatagtcaagatttcgtggggttagaagaaaaaggccaggtgcggtggctcacacctgtaataccagcactttgggaggcagaggtgggcgggtcacaaggtcaggagtttgaggaccagcctggccaatatggtgaaatcccatctctacttaaaaaaaaaaaaaaaattagccgggcatggtagtacacacctgtagtcccagttacttgggaggctgaggcagaagaatcgcttgaacctgggaggcagaggttgcagtgagccgagatcgtgccactgcactccagcctgggtgacagaggaagactctgtctcaaaaaaaaaaaaaaaaaaaattcatgccagccacgggggctcatgcctgtaatcccagcactttgggaggccgaggcaggtgaattgcttgagttcagaagttcaagaccagcctggacaacatggcaaaacctcatctctaaataaatatttttaaaaattagccaagtattgtggcatgcgcctgtagccctggctactcaggaggctgaggtaagaggatcgcttgagcccaggagatcgaagctgcagtgagctgagattgtgccaccgcactccagcctgggcgacacagtgagaccctgtctcaaagaagaagaaagaaaatcagttaaaaatgagtgggttacttctaaatggcccttcaacaactggttatccaatggaagaaagcgaaattgtattttaaaaatgttatgcaagaaaacctctagaatccgtatataatctagggtcttgaccaagactagatgcaacagaaaattatgtatgtttgtttatataaacagtaacttttacaagaaaaaagatgtcacacttgctggtaggcaaaggatattttgtaggggaaaattctgaatagtgtaaactgctaaaaattgaaaaatggacaaaggatatgaatacgcaattcctatgaaagcaaatccaaatggcggacatgaaaagctgcctattcaattaaggtaacatcagtctatatttatcagaccaactaaacaaaaaaatagtaacaccagctacaaatgggaaacaagaaaacagtctcacatgctgcaggaagaagtgtgcagtaagagactttttagaaaactggcaatatctatttaaatgaaaagtacacacgcttttacacagaaacctcacgtttgggaatataccccataggagtgaaactattaattcattgtgatatttgtacaagatatagcaacactgtttgttatgagaaaaattataaatcaaatacacactcatcagtaatgcaatggtttaactgcagttcatcaacactatggaacatcaggtaaccattcaaaagaatgaaatgaagctacgtcagttgatcgagagggacctctgattattacagagaaaaggaagacggagaaaaataaatataacatgattccatttttatatatgtacataaaagtgtatatagttctaagatattagcacagaaaaacaggatacatattagatcatccacgggatccccagggaggtggacagatgggagggtggcaggatgaaataagtaaagagacagaaaccagagctctcaaaaatgcttcaggttaaaggtgacaggttgaacacagttaagatacccactaaaatcacagtaaaagcacactcctcgagaacacgaatgggtataagagtgaatggactatttaaaatgaaaagtaattgacttagcaggggaaagctagaactggaaggagtagaggcaaagcactaattcacccacagaatccgagagaggctcaacagagaggggcaacagcagagaaaacacagatactccactcataatgtaaaaacaaaatatcaaacaagatcaagagcagaaagggctcgtagctaatctctaaaaatagacaagaaagattagcagataaagtagaggaagtctcagaaagaacagagagacaaggaaacaaagaacagaaggggagaaaggatataagacagaaattactctctgacatgcatgagaatcatccaggaggccccacctccagagctggattcagtgaggctgggctggggcccccgaacctgcacatcctaacaagctcccaggtgacactgctgcttctagtctcaggtccacactgtgagatcctgaatctcaggggttttagtgcaaacacagaggaaacagaggggcagaacttgcaaaagaatgaatacaaaacacatttctcagacggaaggtcacgatgctccaggttgaaagggctcatcaagggaggaaagcaatcaacaaaaagacctccactgaggtgtagttctgtgaaatgtccaaatatcaataaagagaagatcctacaaacttctagtgaggagtaaaagggttccaacaaaggaacaagaatctgaatgagtatagacaaaggaacgctgatccagtttatagggtaaagatactttgctggctgctgagagggaactggatgggaggagacagccaggcctgcagtggtacaggcaagtgatatgtggctcaagatagggctggtaaacctaagagtggatctgagagaatttttaggagaaaacagaactcgatgatgctttaggtttaatctggcagtactgaggccaatgtacacaaacggtaacatcactcagcaaggagcttgtaggatggcggggtttaggagctggacaagtttgacaaagtaagagctttgtaattccattctgagacatccaaggagaaaaatgctgaacaggcatttggatatttgggtctgcagctcaggaagtatggactataggtgtaaacttaaatgcttagcctatacacggccttacttgtaagatagtccacagtctaccaaaaaacatgcactgatttcatgaaacggtagcttccaaaagataaggtaacttccaaaattggtgtacctttggaaaatattttcatttgtatttctctcaagtgcttgaaacagctctactgagcactccacaaatccagtgtgtgcaaattacaatgctacctgcctcccaggagctctcaacaagatgcaaagatgtggattccactggtctgctttccctttggggaagccaatcaccaagtcccaagactacatattaaatccctagtgttaccaagggacaggatttgatacgattttgaaaacacgtttctgtccctgcagctatgtgaaatcattttcacatactggacatcaatagcttcagattgctagactccaccctgtctctccacttcctgtacacaaagtatttcttcacctgaatccgagaccgtgccagatacacattggatttccattcagttttcatcttccggtactgcgatgacttggagtgaacaaactgtttactataaggtgcgttcagttctccagtgactgtgctctgaaatgactttgaggtgctggtgctgtttaaggtgtgaggcctgcagacaatggcatatcaacaggaaaaaaatacaaggaaaactgaagatacctctgagtaatgcccaaaaccaggttaattcagattcttactgacagaaacatacatggaaagctgcctagcagagacacacggcgagttctcttatgtagttgggcacatacacagccagacagcagggtttgtaagcagcagacaaatcaagcacaggaaaccactaatacgcctagaaaccctgggctgtactatgtgaagttaaaacaaaataccttaacacaaacctcttgacatgggcactcattttaggttcagaacgggcacaacctgtggggttaacggcaagaggaagttccatgagaggatttcggccgtatcggaaggtataattttcacatgcctcaaccccaggaagctgaaaagaagcaaagcagacacaaagtcaccccatctgatggagactacagacaatctcaagctggtcaaaggatggcccacgacagaaataactcatcagcgttttccccgataataaaatggtcttctagcttatgttaacactattggcctgcaggtagatctacttaaatatgagtatgcaaattcagtttcaaagccaaacttaggtaaaccctgccaaatgctccttgaagaaaaagattagcccatgcaacaaacactggctgaccaatatacacgcttgtgtgatttcagggcctgactgaaacacacaatacccacaaacacagggcatgtaatgattcgcattgagttctttcccctgtattaatgccaacttttatatctctgtctggaattttacaattaaaaacagttaaaaaatcatctatatggtttctttcttgatcgtttctcactcctttcaatttgactctgatgtgatgaggttatcgctctccatgtcctgggagcataaagcataggtgttaactcaagctttactcaaagtcatttacatgttaaaggtcttttctggaatacattgcttgtgaaatttatttctctgtagtcataaaagataagtatcatttaggcagggcgattccaaagaaaacaattaggcacattactcagtggcttttggggtttcctctgcctgtccaaagaaaacacaccaatgatatttttattcttgaaaacaatgccttagaatcatacaattttctaaaactattgtgtagatatggttcagttagactcactgacaaacaggcttgtaatcttttaagcaaagaaatgtcaagagaggacagaaatcagtgctgctgcgatctactgccctctagtgacttcatcctaggaagagggcaggagagtggccataaatacccaagtgtcaggaaatgggcacactgacattctgaggtgggagaaacttcagaaaggcaagggaagaggagagtgtcctcacccatccagcacacccagaagatgtgacaagcctggtgtccttcacccctgcttgcctccagcctggaagagaacctgaagttggttaactacctcaactgggtgaataccaacacggctgagctctcccgattaatcaccaatgccttattcctctaagagaaacgggttaatgcacaggctcagtcactttctgaagagtgccacaaatgttacagcatgtgttcaagtggtcacactgaatcaggaaagcaattccaatctcaaagcctgaccaagacactcactgattccgctatgcgtgccactgcagagacggtcaggccaaacagatcctctccttttaaatacgctgggaaaagctggagcatttcagacttttttctcacacatgccacaggctccaaaatcttatcccagacacctacacagggacaaaaacataatttttataggaaataggatacagtataaaaaacaagagcaaaatgaagaataaccactcacaaggatttactaatttccaaataaatcctgttgggcaataatctaataaatctgtttggtaataatctaatgaacctgtttattaaatggcagcaattttttttaaagacctaaattttggggaaaataatagattaaggacattaaagtgaaaaaacttaatgtaactgaaattcatgcaaacagttcatttactttcatagtggccatataacataccagattttaaaatgattagtctaattggtaatgtctatagctatgttcctttcccctcagatttaaattaaaatgttaaattgatattttctttggaattatctttagagtattttcagactttttttttttaagtgctaaacttaagaaagcagctccacatacttttgtttgtgtactttctacataagcaaaagtgacaatctagacttaaccatggaggtccaaactaagtgtttaatttccatctctaaacttacgtaatatctgatgttcctatacattgtcttatgacaatgtatacagtatgatttagatgtcattcctgccttctagaaactgactttaagaaaaagggggtccctgccaggtacggtggctcacacctgtaatcccagcactttgggtggctgaggcaggtggatcacctgaggtcaggagtttgagcccagcctggccaacatgctgaaaccctaaaatactaaaaatacaaaattaaaaactactaaaaatataaaaattagccgggcatggtagcgcaagcctgtaatcccagctactcgggaggctgaggcaggagaatcacttgaacccaggaggcggaggttgcagggaactgagatcgcgccattgcagtccagcctgtgcaacaaaagagaaactccgtctcaaaaaaaaaaaaaaaaaaaaagaaaaagaaaaagaaaaaggaggtccccaatgcaaatgacaggcaacctttatctacaaatcattctcggatttacctcaccaactcgtatgttcaaagatatattgattatgaaagtgtttagacaactgtatagcaaagagagcaaggtgtgagaacacaaacattggcatttgtaaatgaaaaatacacattataaaatataaaactaacatgagacaaacatggaaaattgacaaaatacattcattagcctgacatcagagtaagtagcactgcacagcatgtgaacggcagacgttacctttaggtgagatgtcacttagaaccaggtcttcatggccttgttccacaatcctgatgacaaacactgggcgcccatccttctcctcaatggagcacaggtagcggcagcgcctattggcatagcgagtgctccagtacagccggctggcttcatagcccacagggaagagtgctttaggagaatggaatgcttgcatctgctgtggaagcagctgaccaattgtgtggaagatgaggctacccacgcgaaaggtatggtcccgttctcctcgttgcacgatgctagcaatctgtcgcacctcatcacgctgaacatagaccctcctgaagactgcaaagtaacttaattcttgctcatgaattccctttggtttgtgcatggggcaaagcatagttttgtccttaaaaaacatgcattgtgctttaatggcgcaagtgaagtgataaatgttggtgcatcgaaatctgtggcatccactagtggcacccgtcttgtgacagaagacacatttcatttgtaggcctctcctcagagctagctccacatttattaaggcaccagcctgagtctcatagacctccgtggaccacagagcgcagttcaagtggacccacagatccaagtcaaggttgagtagccttgctggtccatctgtcaatccatcaccttcttcatgacaaaagcaacatttccgatagtctttgggcacaggatcaggtttaagggaagtgcccaatttctttagaaattcatctatttcatcctcacaaggtggtttaaatgtccccttagggattacaatatgaatgctccacttcttccatttcattcctctccattttttattgagcggcctgcaatcttcaaacccaccatggacagctcttagccgaggcttcagcttgactgtcaccttcagctcatctggcttggcctcgacttgggctgcttcaaaagcaggagggaaggcgatgggtggtgaggcagggggagaagctttctctgggagctgggggagacagtgcacatccaaagtggagatgttgttgctgtactgatgaaatgctttggaaggcgtttctctcataggtgattgtggcaatgaaggaatggattcctgggcaacataaagaaaccatgacaaagaaaaataattcacaagcccggaaagcaattcttgttaagacaagaagctgagcagtatgactgaagaggatgggtgacctgaggggcagagggagagtcagcagtaagtgctgggggctcatgcaccgcagaagctgaccatgctctaaggtgcacagggatagagagcgggtgatggcagctgtgccgcgtcctttcgaggccttttccacaaagccataattctggagaatattctgctcttacactttctgggacaatcccctttctaactatattaaaaccagaaaaagaaaaaacacacacacactcacaatgctgtcagaagagctaatataatttgtacaatggaacagtgttttttgtttaaccaaataagaacgctgcagcatcgtttcttgagagcttatctccactctaaaattcacatctgttaatctcagccttaatcaattggtgtaaatgttacagaaagggaaggagcccctgtcaacaaatgaatcatactaacttttctctgaggcttctcagctctgatccggctgctgaaacagttgagctgaggggaaatctccaatagcttatttactttatggtacagagtatcataaactaataaacaccaacccacaggctgccctcttttcacatgccccaatcctgacaaggtatctgaaaaaagacatgccttataccaaatcaggcagggactgcacaccaacttaaactatctggtgaaaaaaaaaatccttcttgcatttaggctgatgtattttaagatctaaatttatttgtcatctagcctagattttattacaggcatactacaaacaactacctgttaaaaataagtcttcagaatgttcttctgtgaaagacataccagagcaataacctggatggaggaatgactggcagtattactgtacaggaaaagcttccttcaaaacatgattataaacatatcatttgtatcaaccattagttggacacactcaaattacataaaatcaagtaaagcagacctctttcaccatactgtgagcaaagtgttttctcttaaaatgcacaaatagtcttaaattttatctttaaacaggttttcctattggggtaacatcaataaaaatgattttaaaatattaagatatttacggccgggcgcagtggctcacacctgtaatcccagcactttgagaggctgaggtgggcggatcacgaggtcaggagtttgagaccagcctggccaacatggtgaaaccccatctctactaaactacaaaaattagctgggcgtggtggcacgcacctgtaatcccagctactcaggaggctaaggcaggagaattgcttgaattgggaggcagagtctgcagtgagccaagaggtgccaatgcccttcagcctgtgggaccagaatgagactccatctcaaaaaaaaattaaactggtaaaattaaagattttaatattagtgttctgtttactgaacttttaaaacataactctgcccacttctgtcaaataactaagttgaaagagtagcacgactcaaggctccctacaccctctcctcctctgccgggtcagcacctgctttggattccccacacagagctccatgaaggcagggacacatctttattcactcccatatgcccagaacacagaagtcactcgttacacattgttatcagctgagattatcctaatctcaccttgttttctgagtttttcgcttgtgcagttgatgaataaagaataaagcagttattactacagaagacaatgtccttctctaccctcttggtgctttctcgggaatcctgaaaagcaaagagaaatgtgtgggaatctcaacaagtcaaaatttaataaaaacaggatctatacattatttttatgttatattcaaaagtgacagtggttctttatcttaatagtagaaaggaaactatgttccaatatttagcatgtgataatttagctagggaaaaaatacatgtataaaaccaaactatgtggtccacggttcactctatttaaaaatacgtagtcctcataatattccctttaacagcctgttgtagctctttggtgttcagcccaagcacatctgatatacgctggtgccatcaccaggaacatgtgtccatcacaccaccataagtggtgtctctctctgatgttggaagagacactgccaaggacattttcgctggaggtaggaggtggggtcataaaaggagtagcaaagtaccttgttcaaaagggtcagatctttgaaagatttccgcacaccacttccaagaataaccactttacaatgacaacaccactgtggtctgagtgctgcgctttctgcaataccatgactagaatccttatatccagaaagacctaaaggcaatcaacttttgttagtaattaaaactgactgatgacacaaggtggcacatggtgaaaaattatgcagtatcaactcattacaacatggttcattaacattattctttaattaataaaaaaaatttatcttctaagcaatggttacagagtcgattatctgacactagggcaaaaataaagaaacatgcctattctcaaatagctgggaaagcaatggcagtataaaagaagaatctaataaaactaagtcaccaagagagattactattcagtctaagtacaaagtaagacagagagggaaacagatattacttttgcttgcaggttaagatggtaaaaaaacattttatgaaagatacaatgacatatgtataagagtcttaaataagtgtgacttgcagagtcagaaatgaggaaagagccaaggccaaggataagaaggtaaataaggactcaggaattagaaagcatcattcaggtgcagtgtgaaggcaaaaaggagcagggaaaaagtgacagaacagctagaagccaagaggaggaagccagggcctggactgagcacgcctgtaagattgccagtgaggcaggaaggaaagcgacatcatggtcggtctaaggaagttgttccattctcagagatggggggcatgaacacctctgtgggaagagaagggccctatagagctggtgcagaggtaaaacaagaggtaggtgaggatggaaagcagaggagaacaggaaacagaacccacgtcaggtcaccagccccatctgtaccaggtggcccaggtgcagcgggatgggggttgggagacaggaagaacaaaagctgctcaagggcaagcccgtcacaggcttcttctggcagcctgcacagatggctggcactcacatagcccctggtgacagcatgacagaatacacaggccaaagcactagaggtcaaaatcacagcacagaaaacagaacacccacacatggtaagttcaccaaggactatacgccagcatgttacctgtccgttgttaaaagataatcagtatctcaaagagtaagcttaacttttgaatcaggaatggatttggggttaacaaaaagctcactagctcaccattgcttgttggaggaaatggtacattaggctgcttcagccggtaagagctcactaatctgggagggtttgcagatcctggcggaggcccacggagaagtaaatgctgtcgatactccaaacccgggttgattctgtggctactgaccaaacccatggatgggacatctggagcactgctaacctcatagctgttagggattcggacgtgaagaaggtcggaaaatgcagccacaacactgctaatgttctaaaaccaaatgcaaatgctgtattattcacccagaaggcaacagtgaaccactgaagaaaaatacacacttaggataaatcctctttgcatgatacatagattctaagaaaatccaacaaattttatttagacttaaagaacctcaggaaaaaaattagctctaacgaactaatatccaaaaaaagaaatttataaacagaaatcctcataaagggattccaattaacattaaatatctagtaacacattaaactattttagatattgtaacatctgacagaccccgtcagttcctacaggtggtcagaaagcttacttccaggggcttccctccagctctgacacaacccgtaagaacagacaaaggtcttgctactgctgtattttgttgataaccaaaatatcacatcattggacttctagtttggtctctactgaaatgtcttcacagaattcagagttaaaaaaataaaaaatcctcaggaaattacttatgtttgatataagcagatgctacttgaagaacatttctattgcttctgcaaaactattactgttgataaagttctttttcattgcttaattttcttctctgttaacagttacaaagaagttttttctgagatggacatgatggctcacacatgtagtcccagctactgaggaggctaaagcagaaggattacttgagcccagtaagtttgaggctgcagtgagctatgactgtgccactgcactccagcctgggcaacagaaggagactgtgtctctattaaaaaaaaaaaaaaaaaaagagttctctaaagtatacatcctttaataagaaaatgtgagctctaatttccctttttacttgacgtaggctgagaccaattcaatgacaaacgatggcactcaaaggcagctgagaggtctgcagtgagcatcagctctgctctctgaccctttatcctcagtgatcctgtttgtgtgtgttttatggtagacacctgacccatctttgaaaattggggacatactgtttaacattaagaagtcatttaatcttttacctcagcagctgtaggatgcagagtaattgctacagatataagacctgatctgggaccatttggggaaggaccaaaaggtgacgcaaaatataaagtgcctggctcagttttgatgtcattccttcttgattctgaacctttaaaaagagagaaaaaaaagaggaaaatagtgttaatggattttcaaaatcaaaatatttacattagtaaattggcgtagtgtaaagggaaataataaggttaagtgttgttcttacttttcccagcagtgctaggaagaattggaatgatgggggacggcaccggttctggaggctcctccttgaccaatgacagatctggatacctgctcacttctaccccaaccacactctcaggagaggatgagggaacaaaactgtcaggagtatctcgatcaccacagtgatcctgtatcctgaaaaaacataaacacacacatcaaagtctgcaaatccaccactgggggcttcctgtaccaaccctgctgacatctgtgaatacagctgtaaggatactctgggcagcacctatacgatgagcagcaaatgaatcagctcagagccacactgggaaaaaaatacaagaacaatatttagttacaaaataatttaaatggtatgtttccttttaacgaaagcttcagcaccaaagtttgaagacctgccaaagaggaagatgttctgattagcatgtaacatagagagcatgaaagcaccttttcaaaatcccagatcgttgagcctagggcagcactcctgcagcttgaaaaggaaagagctgctggttggatttaacaataaaaaaggaaaactttaaaaagacaaaaaaaaaaggaaagagaagtccaacacatatgcaatggtcacacctgcattcacctgactgggaaaacagctgtcctactgctgctctttacactggcaagatgggagaaaacttagccattgacttgatcggcccttatttttcttaactgataaagtgaggtgagaaaaacaaaagactggtcccttctgttgagttcaagtttgagtctaccaggccaattgtgaggtctcagactaagttccacaaccctgtggaactgctgtctcccactcctcacgcagagaagtagctgtcatgcaggagacccaagaaaggctggcctactgaggtacagtagaaagaggacctggatcctcaattgggacagattattctccacttcggtccaaagtttccccattaataaagtaagggacttaggttaaataaatgtctcatcaaatagagggtagtgggcagattttccaaagaagagataattatttgatgaagttgtaagaaccctctggatctaaagagttggctagcgatcatctactaagggaacttgattctccccaattagaatcttacagttaaagaactgacacaaagacatcaaaccccagacagttcttaaactctcttccacgacggcgttctctgatatagcaacttctgctctttcattttagacatctacaaacaacaataaacccaataaatcacattaataccctttaaaggacaatgatttctgaaatatgttgcatggagattttccactaccttcatgtctattagattatttaattagattaaataatctaatacttaactgtctattagattatttaactctctatatgatgtaggcttaaaaaaatgcaaactaattatgtttaatggtaacaatgtcttataaactttaaatcctgaagattattcaccaaattgtactcttcaaatgtttttacatgctattcctaaagacattatgccacatacatacatttattttttttaaaagaagaaataactaagaattatttgagaaaaaaataacctgtaccttaattcttcctgattgttatgaggtggtgttgggagggaggctggcacatcaactgtcttggggccctgagcaagagctcgggccaacaagtcgtcctggggtctgaagggcagctgaaatggtttaggtcctagagttttggtaactggaaaagcaaaaacacaaaaccataaatacattcagtcaatattgataaatgggtagaactttacaattctattgccatttcacaatacacaactggcagaggcacatttctccgaggtgtgaaatttggaggctataatcataccttcatggctcactaacactccggcttttccagcaagttcttcagttgttgcaaaaccattggccatcttctgacaagccataggaggtggtgtaggaggaagagaggcagggggtgttggaggattacttaaattattctgctgcaggagaccaaaaaatttaaattatatgctactgagcgaatatgcaatgaccttgctaaaacgtagttctgtgaattttttgcacatagaagcaaggctacagaaatgtaatcaagatgtatcttgcacaccaagaaaacaatacctacaaggccaggaggcttcttagtggaacagatactcgtgattttatggacataccaacttgcttactttacccagcttgactacttaagctctgaaattaagaagctaatttcctttctacctgattttatttatgcaattcttcaagtttcgtggttatagctagtgaaggataactttaaaatgcaatcaagaaattgcaaaatattatcaaaatatcctttaagttctcattaagatatgccctagttctatgaaaaacttaagaatttctggtcttaaacttgtaatacaactcacatccgagatatgagaatctggattgactaagacctttaaaagaagcaacagtactaatgctactactaaagtaactaaatcattaatgtagttcctcttcagacacctctcccagcttaacagttatcaccaatttgtcatttactgattagtctctcaaggagagacttggaatctaccaataacaccatgcaaatcaagtgcaaagtcaaattacaaattttgcaaagataaagaatttcatgaggatgataaaataaggttggagaacagcttatgagttaagatagttttttttttttctttttggagacagagacttgctctgtcacccaagctagaggtagagggcaatggcacaatcatgctcactgcagccttgacctcagggtgtggtggtgcatgcctgtagtcccagctacttggtaggttgaggcactagaattgcttgaatttgggaggcagagattgcagggagctgagattgcaccactgcaatctggcctgggtgacagagcgagaccctgtctcaaaaaaaaaaaaaaaacctacaatagtctaggaattacttgtaattaatacctaaattattagatatacttaaaattgtttaatttcatttttcaaggtaaactactactttttttaaatccccaccatttacaatgatttttgaattcattttaagtgttaataaaggttataaggaaataaggatttccactaccatggaagtacataatagatatttcttgcaatttgtattcttacctataaaaacaacttcaaatgtttatgctagaaatacttcaccaggtaaaattttaaccctgtagctgaacttaagttttaataaaacttggaagagtagatgtaaactaaatacaaaaataagacaagctctatcaattctgacatgttacccaaagatgaagcaagacaacaccttggcagagaaacataccttgtagatcaactgagaatagtagtccgaaaccccttccagggtagcactgccaaaagttcctagaagtcgattcccactattaaattggccactgccataaggaagaaagtgcgcaaagttcactccaatgattggttccattagagggagcagagagagctgctattaaaaaacacatttaagagtaatgtacatgataaaaggaactcagtgtagctcaactttctaagacccgaagcaactttgttgaataaggcttcagaaaaatgagacttaaaattttcaagtatcaaaatgctggagtaagtgagagagactacagacctttgagacttaaaaataagctctgtactaaatgaatgctgccaggcatctaacaagaaaaacatatttcttatctatgctcagcaaaaactggggcatcaactgaggctgggtaccaccaacagcactgttagcaactgtctcccaccttctgtaacaaccacaaaggtgtagaacagaattcacaatgtgtttctttggattcagagtcacaacaaagtactgaggacagatttttttcttggtactgaggctactccttatgaacataagaaaatcttgactatcacctatcaatccatttgtattaccgtaaatttcagatgccaataggatacggtgcaattctgcttggaaaaagtctactaggttccttgtccagatgtcttttagcatttgatctctcgtgtccttgaattgtttgttttttttttgtttttttttttgagacacagtctcattctgtcacccaggctggagtgcagtggcacaatctcggctcactgcaacctctgccatccaggctcaagcaattctcgtgcctcagcctcccaagtagctggaattacaggcgtgtaccaccacgcccagtaaatgtttgtatttttcgtagagatgaggttttgccatgttggctaagctcatctagaactcatgcctcaagtgatccacctgcctcagcctcccaaagtgctgggattacaggcatgagccactgcccccagcctatatccttgacttttaaaagaggctgctctaaatgactcaccctcacctgtttcaagtgggtaaacgtgtcagtgctagagtacatagcttgtttctcctcttcgtcctttttccttttctttgagcgaggtgctgctttctcacccgtcctctgagtccgtttgcttcgctgtttcttggtttcacttcctccatctgtttttggcaactggttgccacatccaaaaccaccttgcatttgagcccccaaagtttgctaatgtaattggaaagggtaaaaaataagtgaacaatttgcatatttggtttttagttcatgcagtgccaagctatgacgcgtcatcctaacatggcactaaaaggtattaaataagtagggaagatagagtggtgtcaatgctggttttccaaaaacaccatccttttcttcaaacgttattctcgagtatggaaatcagtaagctgcgaagcttgaggaaagagcagaactcattagtaaggccacagccctttctggcaaagcattacccctcatgctgacctccctggggctggggaaccccttattcctgcttacttactgcagaagggaaggaaatgcttgtagatggctataggagcctctgcatagtggtcttggtgagttatttttggttccccttaggaactagtgaaatatgaggtgtgctgaaacaattcacaggctccagaaaagctttacagcctatgcatcttaggtgagagaacagatagcaccagacaacaataaaaagaaaaaacactggttcttcaaattagttcacaaccgtatttgactgaaaaataatggccacatacttaaagtcaatgggagagaacgtagatgataacaaataaaccttttctttatttttatcattacaaagtgagaataagccaagccctgaaaaggcctttaagggtagtcctatcagtaccttaaaacacaggaatattttcaggctccattatttctaaatttaacagcagtactctgctatagacgattatagtagctgaacttactgtaatgaattctgcattgaatctctgacggttctgaaaattagtttccagttatattctaaatagtttagcgcatggatggcaacatttttatgtaaagagccagatgataaatattgtaagcctctgtaggccatacagcccctggcataattactcaactctgcccttgtacttcaaaagcagccataaacaattcataaatcaatgagcttggctgcgttcaaataaaacttttaaaattcacggacaaatttgaattttgtataatttttatgtgtcacaaaatactactcttccttagattttttttcaaccatttaaaaatgtaaaagccatttttagctcatggagggaggcgaaagcaggcttagactgctcatctccaggctagttctgtggctctcaaggggtctccagggcggcagcagcatctagagctggtctagaaatgcagattatctggtcccacccagacctgcagaatcagaaataccggggctggagcccagcaatcttggtttaacaagccctcctggtgctcctcacactttagctttgagaatcacctgcctagagcagtacttctccccttcagatgctcaggaatcacctggggatcttcctaagtctacattctgagaagcaggtgtgtggcgggagattctgcatgtgttacaaagctcccacctgatgtggatgctgcggatccccaaggactgcactctgagtggcaagaacctaaaaattaattatatatatatatttatatatttatatttatatatatatttatatatagatgtatatatttatatatatttaaatcactatatatttatttaaatcacactttaatttggggggaggggctactttttaaacttgacgtggttgttccccatgccattaaacattcttacacccacaaattttaatataaacatgctcaaaatgtagtctacgtccttcaaggagctatttaaataatgttaagtggtacaacagaaatcgctatgtgagaacacgagcatcaacacatatttgagattgggagaggtgagaaaggtatctggaaaaagatgactcaagaactgcatttcaaaagataaaaatatattgtccagacgtatataagaagggagaacagaacaggcagaagcagcagcatgtggtatacatagaagggtaaaaagacagaaggctgcaagttattcagtactcctcagggtataagatgtcttggagaaagtggatggagactgtgctggagagttgcctatatttactggtgacaactgtaaaagcataaccagtaaaatttacaaaaattacacaaatctatcaagtcaacactcaatctctactgaatggtcaaagacaagaaaaaaagcaacacttgcaaaaagatgagcttcattaacaatcttaaaatgaaaaaactggacaactaaatataccactcaacccttaattaaaatatgaaaatgaaatccaatttgagaagctctctagggacagctttatgaatgcactggtaatggcactgcaccttctgaaagataaacaggcaagagctattaagcagaccaattcccatgactcaaactccagttttggaactatcttaatgaagttaactgaaataaaggggacagattcttgtaaaggtatatttacaagttagctcttcatgtaaatgaaaaaaaaagcaaattaaatgttaataacttaaaactgatagaaaattgatacatggaaaactacaaaacagtatctacatgtaacattacattaagtatcaatacaacactgtaaccacacaatagcttcccagtgtggtatccctaagagtgccaagggtattaataggggtgcatgggctatcctctgcattttaaagaggttaatggaaattaatcacttatttacaataaagtacatagacatttacttactttgctttagtcatatcaactcaatgtggtaataaccagttgctacacatcacgttatatatgaaatgcaatacatgcctttgctttttaaaaaatagtaaacaaattattatttaatatagtttagatataagtaaaaacatgggttccagagaggtagaaatgacaaaataaaaaatggtcctttagaataaaaaggttgtagaataatgtggaaatacagttgctggtactaatctgctgtaagtataatttaaaacaaaagaaaaaagttgtcgtttttatgatttacacttaccagtccttcagctgggttctgcttctcaactagtttattatcctttgtacagtcatcttctgaacaaatactgccctcaggtttttgattcaaaagagaagatgactttttatttttcaacaagtgtttcagaagttcattccctgagtctcctttggcagcaggggccccagcagaatggggaggactctgtgctgaggagacaggacaggctacagcgtttccttctaccttactaccattctgttcctccaatttaggctcctcttggcctgggcaggactctgtctcagccttttccagttttatctcttctgttttggcaggggtttccatggagagcttgtctacttctgaatttgcatacgtctgttgatttggagttgcttgtgagaaatcactattgggcagtttgttctctaattctgtacatagctggcctgctgccatattgggagtggatgggccgactggttccaccgactcttggtcggcttgttgaggaagctcactgggtgtgctcactgcaggagtagaggtagtttctgagatgcctggagtcggtggggcagttatatctgaatggggagttgatggagccttggtggattctgcatcatcatctcttttcttctttcttgttcttttctttttccctttttcctctgggattatatcagaatacaactgaatgagcgattgggttgatcccggataactgtgtccatgggttatagtagaatcttggccacatgggagactgctattagctactggaggtgctgctggtaaagcaggtgtaaaagaaggcctcactggggactgctggaagctggtcccagaaagatttccatgtccctgcttcacagaagaaaaatttgggcttccaacagggattgatggtgaatcaggaacaaatgaaggagggcctacctgccttcgctcattagtctgcatgaaagtttgggtggagggtgaattaattgatccttgttgtatattctgctgctgtaaaacctgccccatttgctgttggtgttgtggagactgctgaaggggtcctagaggttgcataaaatcacaaggtaagtcggaactgtagaagggaatctgggacacagatgtcctactactacttatctcagagcccaccataccatgctgctccatttccatcctctgctgcaaagctctttgtctatctacctcctgcatgagttggatccgttgtctctcttgctgttctcgtaaacgttccttacgttcccgttcttgaaaactttcactaaagggattgttgtcatcaaattctacccgaggtggtggtccactctgtggatttgcatttgagactgtccctggggctggtgtacaagtttttattggtaactgggcaattgggggctgaattctaggaggattgaggggcaggtgggcaggagcactgttgggttgccatccaggtaaactgggcattctaacagggctagtatggccagaaataactgttgtgtgctgctggtgctgaagctgctgtggcaccatgggaaaggtgggttggctcatggtgggtggagtggcacctggaattaggggtggctggggctggacactgggcatcatggtaggtggggccattgcacattgctgctgctgtttgatccgataatcttcaatcaattcagcatgttctttctgttgtttacgaatctggaataacaaaatgcatcattactcatttctatacagcataggtactgaagtaaaacactggctgatgactgtggttgaggttacacagagggcagtttggccctgcagaagcaaacatattttgcttgggtaactgcaaaagtcacaaaaaaattgaattgataagccttaactaacaactgtcaatctctttaacaacaggatttttataaagttatctgtaaaagtgcttcacatatgaaatatcaaaaacggtttagtaaaatattaaaatcttatggtgaaactcatatatactatttatactatacataaaaaatatacaataaaaaaggttacacaagcagctaattttgatgtcctagaaattacaatatacaatgttagaataacagacttaactcaaacttgaaccatttaaatgttaagatttcatttcttaaatatataaattgtacaacattttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccactgcgcccggcctgtacaacattttaagacaagatgaattaccagcacgaatatcacaccccccacccagattaaaaagactaaatttgttgaacactttcaatttaatggctaacactcaaattataatttctgaaatctatacaagctccgaggaagtattttgaatagtctgtaaatagactcttaatataatggctaatatcaattaattaattcattccaaaaacctttgtgtcccaatgtgctcaatactacaggccagatatcaatcaagacgcaaactatgttctggagaacctcaccatctcattcagcaagctagggaaagaaggaatgcaaaaggatgtgtatatctctcaacatcattcaatttttagataaatattaatatactaaactcaggagttctaatagtttttcaaagtattttcttgggttccccaggtagactaatactttctgcaaataatcgtgtttcatctcttcttcaacagttgtgtaactcctattttcttatttttcctggccagtttactggttagaactgagaaattaccattggttggtgaagtagtaagaaagtacagaaagcacctacaacactatgtgggatatataaggtggtcatccatgtctttcccatgatattttataatactttttaaaacattaccatcaactgcttatcttaatatgattatactggatctttggcaactatgtaatagatgatgtatcccatttttcaagtattagcttctaaataggatttgatctatggatatgcaaaaattaggccctcatcaaaagaccttgtacaaatatgccagatggcaatgaaagtgctaaaaaaaatatactttattaaacatatctttacaagaatattaacctacagtaaacatgaacccagagagtagatttaaagagaaaagaaacctttcattctggaataatcctagttttaaacaactggaattatgatcaccttattgttggtacattattgtggtagctgtggtttgaagataagacacgtgagtccaaatccctaatctaatagttataagcaaacatgtacagtgggggtattttttgggattttttttgttttgttttgtttttgagacaagagttttgctcttgttgcccaggctggagtgcaatggtgcaatctcagctcactgcagcctccacctcccggattcaagcaattctcctgcctcaacctcccaagcagctgggattacaggcacctgccaccatgcctggctaacttcttgtatttttagtagagacgagttttgccacgttggccagctggtctcgaactcctggcctcaggtgatccgcctgtcttggcttcccaaagtgctgggattacaggcgtgagccaccgtgcctggccacgtgtacacagtgtttataacctttacaatgaatcagtttgtaaaatggggataatactaactccttcagaaagatgtagataagacaacgtaaatggaagtgcttcctacagtgttcattatagagcactcacattttttttttttttttttgagatggagtctcactttgtcgccaggctggagtacagtggcgcaagctcggctcaccacaacctctgactccttggtgcagggattctcctgcctcagcctcccaaatagctgggattacaggcacacaccaccatacttagctaatttttgtatttttagtagagacggggtttcaccatgttggccaggctggtctcaaactcctgacctcaagtgatccacccacctcggcctcccaaagtgctggaattacaggtatgaaccaccacgcctggcctgaaccttaagtttttaatttacttgggtaaatatacctaggagttggctctgaacccattttgtacactactattgttttattttaaatacaatttttacatgtttcttcttttccagtatattattcagtttaaatattctgataaacttctggtttataatagaagataatggcaaaatgatttcatttttctggaacagtacttcacataagacataccaatgtattttaagaccaaaacattaagaaataataataatatcaactccaagtaaacaaaaatactccctgggcccccaattcttattccaaactaaacccagtatctccccatgagctcggtcctcagttaagtcgaatactctcaatgatgtataacagaaacatggtctttgcagtgatttcttagtgcagaaaaaaataacgtctccaactataccaaagttgaaaatagttcttcgaagtcgaaattatgagactcaatctcttttgtgtcatttatttagtatgtgctgtgaccgtcactttaagtaaaagactggagctgttatggctgcagttactaagaggtctcagagctgtcactttttggcaatgtacttttaatgccatttaatactagtcaaaaaaaatcactagtcaaagtcactaatgaacaacacaccaaaacattctactcattaattgttggtagtttctattttgcaaacctatttattacctgttctagctgtttctgaaccatgctttgctgttcagtaacatgcttgagttgttctgcatcttcctctggaaattcacgcccagctttcttggcagtacgttgtttagctgaaagggccttcttagattttctgtgagcaccaatttgttcttcaagatacttctgctgcatttgaagcagctgttgggtctcctggagccactcttcatactgcttacgctgtgaatcatctgaggaaaaattaaaattcagttgtgttaattttctaaagagtccaacattataagttacacaaatctattttgtaaggaagtagtttcaccatgaccacataataggaaatttgaaaacacaatactaaatattagacgattatgtaatgataaaatatcagattttagaaaaatatttaattgagaaagccagagaatgcacattcttgagatactggttaacttagcacttataaatattacaaatccaatcttggaaaagcagacttatgtaatgaaattctttttttttactaaacaaattctctaacccacaagccaaactacatactaaggtatacatgcattttatgaatacgattttacagattttgaagagacaaagacatatcccattaaggtctagcgcatagactaggaaatcacttcccatgttaattttcctgagtttataagttctttcctatttcttaataatgaaaaaatatcctaaacagagagaaaaggaacccagaatgttttagaatggaataatttaaagtctatgacttataaaggaaatccataagttgaaaacattggtaattattattctgtagttatattttttaaaataaggggagggaatagttaaccaagcaaaacattttctacttttacaactgccagtaattctccccaaatggctatatctcttcattttgtaccaatattctcttctttattctttaagggcactttacttcattgatacccagtccaaggggaaaaaaaaaaagtcatcgtatgtagtgaaattctgaatatacctttttgactcactacaagacaaagaaatgaataaatacatttctaagaaggacattcgctgaaaataacatcaatgataacagaatattgtcatacattaagaatccaaccaaagccaatgggcacaataaagccagaaaaagccagttggtatagttctttacttgtttttaatgcaaatatgtattcaaattatagtaacaattaatgtagggggaatttcaaaaggtcagactttgggtttgttcctaaacccagaagttccagtacatgtatgaacttgaaatctagtctactaaatttgaagggcattttttaagaacaggctttttcacaagatttcagaagttctgcttctggtagaatgagacctaccgcaaggaaagcctttctggtttctggaaccaggagagcagaggtgagcaaaatgaaaaataatggtgaaaaaaaagttagctaaacagtctgaagatttcagaaaggttcagtttggggagaactttaaacactatcctgaaccaccttgggacccctgcaaataactagaaaggattcaggggcaccttgcatacctgacctttacaccatgctgctaacccaacttactgctaagtataatccctttgtttttcccatttagtgtccttgtcacttaggaagacagttcttagagcaaaacgtggtttagttctatagactgtaaagtgcccaatctgtatacaaaaacagcaacaatattgaagagaatggggaagatggtttttctgtattaaaatacttttctgtaactataattcttcatgcacagtgaaaaaagcaatgaaaacacacgccttgaagaagagttgcctaatagggcagtgatgtttaataagacaggagggcacctgggcttgaactggtgtacctacactcacttcaggtttagaacagcacacatagagtgcagacaagcaatccccagaaaacattaacttattagatttatacttactgacaaagcctggaccaaaatttggaggattaggcctagaaatctgatgtgttatactgccatcctaaaataagtaaaatttacaaatatgtttattccacatttcagttaaaggggggaaaaaactttaaaagaaagaaagaaaaaaagaaatggaagaaaaaaccctttaatttcctaagatatcttttaaaggtttttttataaaaagtagagtgaatttagtggtggcaacctaattctgaattcttattactatctctgaactactatactgtctagattttggctgaaaacaattatgcttgaggtaaaggattattcatcagaaatataatacagggcaaatcaattactgctaatactaagcgagagatctatataaaaaatctcactttttgatgaagtttacctggtttcttcttcaatcaaacacaagttccagattgactaaatgccactccacagcatggttatttataacaaaaactaatgtctctaacatgcacaaatataaaagaaaaatacgttaataaaaatattagtcttattttctacacacgcctgtagtcccggctacttgggaggctgaggtggtaggatcgcttgagcccaggtgtttgaggccagcctgggcaacacagcaggatcctgttcccaaaaaaataaaaaaaataaataaaaagtatttaattcgttttattttcaagttaaaagtcttatttcttccaggtgactgaacaagcagttattaatctcacaagtccctgataatcacctaacaaattaatgttgaaaaatgtttatccagttgtcacaagttctccttaacatgagctgtatacaaggtaataattataaacttatactagcagccagaatgtattatgtgcaatcttcacaatactacaaagcagttggtttaacatttgacatattaaaaaacaagaggctaaagaatttgcccaaagttgcacagtaaattcatagtggaactataatttctttaaaaaaactcagctataaaggctatgcttttcccattatatcaaatggcttctgtttcctcttttaataatgagaagaatataattatcagcataataaatctaaagcataactggcagggcaaggaagaaaacaggacatacattatagtaggtagctccctttataaaaaaaaaatcactgacaaaaatactgcatgagttttacttccccagatactgcttgatattatattaaaaatatagcatatctttcaacaaggatgggaagaaaaaaggaaaaaacaaatatagcatattgttttctacttgctgtgtttgtttgtttgagatgaagtctcgctctgtcacccaagctggagtgcagtggcgtgatctcggctcactgcaacctctgcctcccgggttcaagcgattctcctgcctcagtctcccaagtagctgggactataggtgtgcgccaccacgcctgactaatttttgtattttttgtagagacggggtttcactacgttggtcaggctggtctcaaactgctgacttcataatttgcccatctcggcctcccaaagtgctgggattagaggagtgagccaccgtgcccagccattttctagtatttatagaagttttacattttaaatataatgggtttaattctaaaatgcaggacatgaaaatgtccttctggagttaaaaataagtaaataaaaataaaaccaaaagtcctgagcgtgtggttttgccatcaagtgactttttacccgtaagtatataaatccttttcagaaatcacagccaatttttttaaccttaatttgtcttttgtttaaaaagcagtaaagtgtctttttggttacttttggctgtgctgatagataaggctactatttaggttggtgaaaaagtaattgcggtttttgccactggcaaatggcatatggtgaaatccgcatttacttctgcacaaacctagtactactctctagcaggggacttactctaaagcatgagtttgctgggaaacagaaaagcgtgcattctagagggactcattacaggcagtgttacctgaggaatggcctgtggtccaaggttctgtccttcactgttctgtgttccagttaccacctggcccataaaagggaacctgtcaaaacagggtacacaagtatcaagtgatgagcgtttagaaattattaatattaattaaaaactgtattaggtgcttaacagttttctcttccagagaagaacagtggcaatttcttcttcatcaaaacactaaagccctacctttcatgtactgggcagatgtgatcctcactgtaattcgatgaagtgtgctcttagcaccctcatgttacttatgatgaaagtaagattcagagatattccgtaaccttccccacaaggactagtagggctgcaataagaagccagctaggctgactctagaggttttactctattatgtgcctcactccactttacgataaaatgaattcaagacttcagaataaaaataagttgatttagttttataacgaactctaaggaaatgttttctcattccagtctgtgttaaaaactaattgagagcttagttattttatattctaaaacaaaagacatttcccaatttaagaattttcatacattttcatacatttctatatctaatgttaaagcaaatcaaaaatggacgactgaccaagatcagtctgcatggttaaacgtgtttagagaaatgttactcattctaattaaaactataaaaacttcacagaagcattactgcttacatgaaagtatttcctctggcattatcaaatgctttaacgtatcaagatatacatacaattttaaaaatgtattccaaaagctgtatattactatttaagtactattaggatatagaatatgtttttaaattttttactcaggtttttcattgatctgtcaccctacccactgctacaggtctggtctaaatgatcttctaatctgaatatcacacatggtctatcatcctaactcaacatatcacactactctaagaagggactatcacttccatttctaaaaagcagtcagtagaatactaagccatatacctgatacatgactaatgtatctaaccggcagatgcatgatgctaaaagagcatcagatgctgaaaggcctcaaattctgaggtccatatttaaaactaagtgctggtcgggtgcagtggctcatgcctgtaattgcagcactttgggagggggaggcaggtggatcacctgaggtcagaagttcaagaacagcctgaccaacatggtgaaaccctgtctctaccaaaaatacaaaaattagctgcgcatggtggcacgtgcctgtgatccgagctactccagaggctgatgcaggagaatcgcttgaaccttggaggtgaaggctgcagtgagccattgcactctatcctgggcaacaacagcgaaactccgtctcagaaacaaaaaccaaaacaaaactaagtagtaaataaaactcagcatttccttgttttgaatatacatagaaactacaatattattagcaagtaccacaactatcaccaatagaagacagattattttcctatcgagtgttgcaggcacctaatagattagttatgttcatcattactttcaaattatggtttattgctaaatttgttaatactttaaggaacatatatacataaatttaattatattttaataactatatttcaagtataatcatttccttcgtaatgctatgtcttaaattttctgcatataaaacattctgagaatttcaaaggcttcactggaatccaaaaatattcaagacataaaacagttaggaatctctatgatagagaaatagtgttaataaatattgctcaataatgaaaatcattggaaaccactatctctactttgatctcaaaaatgcttcttaaccatgtccaaagtatctcaacaattgaaaagaattatacccttaagaattcaaatttctttgaaatatatacatcttaaattcgtgcaaattttatattcaattctataatcatccacattttttatataaaagtttttcaacaagataactagactaaattgaggctctatgcttactttattgacagaggttctcatatagtaatacacgtaagactcattcatgacgcttgctaaaaatacagacacacaggcaaccatctccagatattcttatttagtaggtctgcagtagagcaaaataatctgcattttaaaaaaattaccccataattctcatggtggtccatgatcaaaatttaagaaacagtgccatgtggttaacaacccttagagggcataatttcaaaaattcagatattgaaataacccctactgtcttctttaatgcgtaatttctgtttttctcctaagagagaaaagacaaactctgtaactccaacttccaactgtcctcttatctattccttgtaactttctttttctgattcaaaaccggtttgggaacattttattttagaactgaatttataattgctttaatcactcagtgtcttaactgaaaaaaatcttagataacatgaacaattctaaaggtatttaaaagagcacagacctaaatactttgacttgagtaatcaggaaatccaatcttccaaatctttttaagatgttttacatttaccatccttgagactaatgctcttaaactggttcttacactaatttcttaaattggtatagcattttgtatctgatcatatcgagctgatgccatgacaacttaaatagtgttgttcattcctagacaagggctttccattttctgtatgttttttctaaaaactagtaatgatttcatgaatgtctagatgcccagtagaaacaagcagccactccacctacctgctcatcaccattggtggcatgcccagattgttttgtgccatcactttatttatacctttaagggccaccattttggctttcattataggatctgtaattgcatcaaaatctagaaaagaaatataaagttacttatttcatagtaattagttcaacgtacactaagaagtaattcaaatattacaagctcttaaattttattatttaataatcattacagatttctgagatggcaaccttatcctgggtttaatcgcatctcagtagtccttaactgaatcatgctttaataccttagtcctgcaggaattaaaacaaaaagtcaagtttaagggagattataagcaataatctaaagcaatgcaattaatttcctttcatccaaacttttgcaatgctaatcagaatggcttctttagtaaatataacatcacaaataagaatttgcaatactaaggaattctactaaattagttatcactcttaaaagaaaaatgcaccaatttcttaagggtataacctctcaataagaagctactacgaaaaaacctatttgcatctaaatgaaaaaaagggagcaaaatgatgaaattggggatatataaaatggaatgtcaattttattatttagaataaggcacactgcttagacacgtgccctttgattgctaattcttattcttagaggcactgaggcattttgactgcattgcttttgttgtttttagaatcagtaaaccattagaaacaagttaaagaggtttatatagcaaaaaatcgccaagcatttgtcatacacaaaaggacagtaagaagctttatttccatcataattttcttaaattcatccttccatgactgaaaacatatggcaacaatggttggaatgtaggaactaagaagacaattagtttctattaaacaattccataaataatagaattgagggaagtttgtaactcagttttgaatctcttaatttacctggaaagaatctaaaactcttcgttgttttcatttttttttttttgagacagagtctcactctgtcccccaggctggagtgcaatggtgcgatctcgcctcactgcaacttccgcctcctgggttcacaccattctcctgcctctgtctcccgaataactgggactacaggcgcacgctgctatgcccagctaattttttgttatttttttttaattattatactttaaattctgggatacttgtgcagaatatgctggttacataggtatacatatgtcatggtggtttgctgcacccatcaacccgtcatctacattaggtatttctcctaatgctatccgtcccctagccccccacccccgacaggttccagtgtgtgatgttcccctccctgtgtccatgtgttctcactgttcaactcccacttatgagtgagaacatgcagtgtatggttttctgttcctgcattagtttgctgagaatgatggtttccagcttcatccatgtcctgtgttgcccaggttggtctggaactcctgagctgaggcaatctgtctgcctcggtctcccaaagtgctaggattacagccgtgagccactgtgcccagccaactgctttcattctaaagctcaaggagggccaagcagggtggctcacgcctgtaatcccagcactttgggaggccaaagcaggcggatcacctgaggtcaggagtttgagaccagcctggccaacatggtgaaaccccgcacctctactaaaaatacaaaaattggccaggcatggtggcacgtgtctgtagtcccagctactcgggaggctgaggcaggagaatcacttgaacccaggaggtggaggttgctgtgagccgagatcgcgccactgcactccatcttgggtgacacagtgagactccgtctcaaaacaaaacaaacaaactcctcaaggaggaatagaaaaactcagtgctttattccaactgtaattctaataataaaatcttataagcatatcgcatgccactctaatacccatagtaatatacgttgagactcaagaaaactcctaccaatattagggaagaacggttctgatcgctgacgaatcatggcttgcatctgtctttgctgctgctgttcttgcctttcttgatccaaaagatcctgtagaagtagaggctgttcttctagaagaaggggcctctctctattctgctgtgctaatgtttgaggaatcattagctgttggggtccagacatgctactggtaccagactgacttgtttgaggcccagtttgagttgcaggttttcctgtccccagactgtggttaactgttgattgacctggaatgagccctgggtttacctgcacaccctgagaaaaaacatggtttaccctagagactactgtcacattagaattcatggcattatccaaaacacggccaggcggtgctatgaaaggaggcaaacttgacacatgattggatggggaggccggcagagttggtggtggtggagaccccgatggcctaatgtctgaattatcagatttctcattagcaagtaaacttgagagaactggagttgatccagttatgccacaagagtttattacatcttgagcaggtagttgagtggatgcctgaatgacatttgcactggggccagcagtttctcgattggttcttttctcaaatagatctggatcacaaggatgcaaagaagtcttttctccatcatttaggtctgagtgagcagaagcctgtgagcaaggagtgtcaacattatctttattctcatcatttttttcagtttcacatttggattccaccttagaatttggagacagtacttccgtttttacctcattggtaacagtggattttttctgtggtgaatgtttatcagagagaaccagagttttgttttcttgttcctttttttttggttcaacagatacacactgattatctaacttatcatcaattggaaggtctagttcctcattaaacatgcttttcttatctcccatgtcaagttctggatctgtatatgcaatgatatcaaactctcctgaccttaagaggtcatccaggttgggatcattagtttccaaattatctaaagtatccaattcaactaccttgccatcctctgtatctaaatttaagttttcaagatcttcatcatctaagtctttgacttcaaccccctcaaggtctttaacatccagttccttcacagaagggtcatcagaatcaagtttttcctctagaccatcagaaggctgggtggttatctgtaaattatcagacgttgtttcagacggtacagatgttgacaaaggagcttctgaaaattcaccacctagtggatggttcagagtcctcatgaccatagaagatgaatggacagaatgaccttgctcttgttgagatggtggcacttgttccaaatctgggtgcacaggtagctgattaggtagaccctggggaggtcgtcgcatggggtctgtgtgtctagggcccggaaagtctggccggggaatgaagtttccatgtctcagattagaagatgcctctacaacgctgccaggtggagcactgaaaggcagccgttgccttccgtcaggagccctatgtctcagttcaatatatgcttggcccagtatgttgtgctgctgaactggcaagctctgtggtgaaaaatgctgaggaagtccaactggattattcatttgtgagttatttaaaggcctaggcatatctacagatactgatcttcttagctgtggagaaactccagatccctgtatttgctgaggaggcacaaggaagcgctcttgactcggcatggtaccatgactacctcctggaaatccaaatcttttaaaaaaaaaaaaaaaaaaaaaaaaaaagcaaataggtattatgttaaatttagagttaagttgaaaaaaagaaaagtcttcaattaaactgtacatacaaaatgttgccaaatactatgacttacaaaagcaaagctatcaccattaaaaagtatttacagtattcatatgcaagtaagattttgctaagaatcctataatgaacaccatatctgagctctaaaggcttaagatttaacagataacaaaaatgaagacaaaggaagaacaaccaagcagatgaaatcaattgttcagagataagaacaatactactggactttttcaggaagagtttcttttatctatatttagggaggttcgatggaggaagctgattcggggatgatgtttgaatgaagataggtcttcatacctattgagggacttacaggcctcagtacatgagactacaaaggcacaggtttgatgatgggatagaataaacttagagaaaaggacaagtaggcctcatctataaagattaagtaaatgtataaattgttggactattttatattgtacttccttctagacaggattacaggcaacttacacagaatacaaagcatagcaagaggcataaattataacaaggtggaagaaaaaagggaaattaagagtaagattacaggcaacttacacaaaatataaaatgcagaaagaggcataaattacaactaaggtagaagaaaaggaaactaaaagaatataacatggaggtagagatataagactaaaagacataaaactaaaaagcatatcttaaagaactatttccttattataactagggcataggtttggctttgactttagccactttgaaaaaggaaacattcttatgattcatcaccactaacttacaaccctatctcaccatggaaagttcctaaagggaaagtcctttcagttcggaaatctctaaaatttattattattattttttaaattgagacagagtctcgttctgtctcccaggctggagtgcagtggcgtgacctcggctcactgcaacctccacctcctgggttcaagtgatccttttgtctcagcctcctgagtagccgcgaatacaggtgcagtgcctgccgccatagccggccaatttttgtatttttactagaggcagggttttaccatgttggccaggttggtctcgaactcctgacctcaagtgatccgcccacctcggcctcccaaagtattgggattacaggcctgagccactgcgcccagcctaaaattaatttagaatgtaaagttaaaaggtagaaatttggagagaggacaagtctcatcacatcgtaggaggctttgcctacgcagaatagctacattttgaggatgtcatatgataaactgcatcattaagggtgcaaggtaatgctaacacagttaatacttaaaaacaaaggtaatgttttcagagtctgtagagttcttagaggaaaaaaatgtctatgacctctcattagcactaaatagcagattatatatatttcaaaggggagaaagaagtagaaagcagtaacagcttcctgattaatactaacttcatttgtctatttcttttaaaaaatttttaaatttgttgaagaggttgggggggggggggggtggtctcactatattgcccaggctggtctcaaactcctagcctcaagcaatcctcctgcctcagctagtagctaggattacaggcacaagccaccacacccagctctgtttccctcttctaatagcaatttaaattcggcaggaaattaaaagcattacctaaatccatgaggtctcatccccatactagcaacatcaggaggatagggtccacgctgatcttttgggaaaacagcatatctaggtcctaaaggaggggcaacaggagacctaatgttcccaggatagggaggtgggggtctggtgaaagcctggttaacattctctggttgccagtgttgaagaggccctggatgaggcactgcgggtgagtcctgtgaccccttctcctgtcgacctgcaatcttcttctgctgttgctgctggagaatgatttcacgtaacttctgccgctaaatgggaagaaacaaaaatcactgggatttgtggtaattaatggctttttaaaggttactggctttttatttttagatatgggatcttgctatgttgcccaggctggcctcaaattcctggactcaagtgatcctcctgtctcagcctctcaagtagctgggattacaagcatgcgccaccgtgcctgacaggttagtggctttttaaatcctgatactttcattatgtggctatggtaatgtttcaaagtttgatgaaataccagttacatttaactattcaatatattaggaaaaataatttgatgatttgggtccttttccttgccagacaactatcacaaaacaaagctttaatatttaaggattcccctgcgaattcgtgaaaactgaaatcagatacagaataaattaaactggtgttaatttcatcaatttcatttttcttttttgcagtatgacaaactctacagaataaaaaaaataaaacattaactcctgtgtagaaattactcagtttgatgaaatgaacagcttcctcaaataatacatttaaaactgagaacatacaatgtgtttacctgtctcaatttctctgtatctgcttgggccatatttacagtattctgtgtatcagttactcctgaagttggcacaggtccaggaagttgggagacaccagagaactgctggccttgggagtgcattggagagtttgaagatgcacagaagctcccctctgatccaggccttggctgatcagcaacatcatgggcagtttgacttgttccaaaagagtcagactgagatcttggagtcattggagactgatcatagggatcacgggcagcagatggggaaacacggctaaatgtgtctgaaagaccaggtccagggggcctaggtgtctgggaacatgtatcaggtggccttaccaacgggccaggtaaagctggtcctcggttttgtgctgcttgcaggaaaggatcctgatttggcatgaggactggtcttgtcattgaggacctagtaaaaccctctgaaatccttggccttggtgttgctggtggctgagagtaagggacagaaattccaggtcttggtgttccaggaggatgagcatatggatcagaatgcctctgatttgttacaggtgtaacaaacaagtcagtttgtgtagatggtcttggggtttggggctgctgactatatgggtcaacagtagtaggccggggagttccaggaggttgagagtaagggtctgtattggacctagctgttcctgaagattgggaataagaatctacaacaggtcgtggagttcctgggggttgggagtatgggtcctgagatgttggccttgatatggttccaggctgggaaaaagcccttgaaggatgggcaaaagattcattcactgctggatgtggggtaaggggaggctgactatatggatcatttgactgattatgagaaaaattatctataggtcttggtgtcaaagcaggcctttcataagggtcaacagacaatcgccttgatgcctgtgacactgatccataaggatcctgagaggatggaggaggttgcattggagtcttaaaaggtccaggaccactatcaagaggtgcaggtgtcaacaagggtcgtgcatatgagtcaggtatcctttgtctttgaaacacatctgccctaggagatggtttagtaaagtgatcactggttccagctgctatagggccttttgcagtttgttctgaaactacaggagaccgggataggcccaaggatttgggaaattgatctgtcatcacaggcctaggtgtgtctggaggttttgcataggggtcattatttgtcgtggaagaagaacataaatctctgacaggggatggcctatttgctgttgtctcattcatttgaaggggcctagataccgatgataaaggtgtacagttttccactggtgcagcagaatttcttctggaaaaactatggcccacaggaggtggtcgaggggtaccaaccatttttgcatatggatccattggagatggtggtcgtgagttagaggacccaggtgaaaacacttgcggtgagggtggctgagaagtctgagcctgagaaagactatcctggatgggaatccgggatggggctggaggaggaggtggagcttgtggctttacaaacacatcatctgaagatgtagacgtaggggtactgggtggctgttttgtaaacagttctttatggaatgactgtgcaggagacatatttccattgccaggctgaggtgtcaagggactctgtatcccactacttggtgtatctgaaccagactgcaccagaagatgctgagaaccaaattgctgttgttgctgctgctgctgctcatttttcacctgttcaagtttctgtgtggcttcaattttagcttgctgcttacttttctgacgcatttgctattaaaatagaaaagaaaaagcaatcatatttaggttaaggaagaaaactaccatcatggggggaaaaagcaacagaaagttaatttgtttgatgtcagcgctaccagattgctcccatattagattatgaattcctgaagaagagaaattactcatcatggtatgttccatttgtgcctagggcagtatattgtttataatatttcaataaatttctcaaatcaatttaaatatattttactgaaaagagaaacaagtctatcctaaatcaaattttcatggtctaagaactatattctaaaataataatgcaaagacctcccttctcaaaacaaaaatgcaacttcaaaaagtagattatccaaaaattccatacctgtctaaatttccattcctgttcatgttctgattctctttgctttaaaggatctttaaaaagctccgaatcaatacgagagctgggatcaatgctatcttgctgttgctgccttttcatggaatcatttgacatctgtactttattaatgcgtaaagcagctctgttatctctggctttttgctttgacaaaagaagagaaaaaaatttcccagattatgttaaatgttttaaggaataaaataaaactatcatgaactttctcaaataaaagaaaaaaaagtcaggtaaaatagctgaaatacttacggcacctcccaaaaaaggatctggacactaactcatcttctctctttacagtgcatagtacctatcagttgaggatatatttctatgtatttgaattaagcttaaagatcctaggtgtgatttaatattttagctcctagttttcttaacatatccttagaaattatgtctccttcaatttagaaagaaggggctggggccaggcatggtggctcatgctcgtaatcccagcacttcgggaggccaaggcgggtggatcacctgacgtcaggtgtttgagatcagcctgaccaacatggtgaaaccccacctctactaaaaatacaaaattaggccaggcgcagtggctcacacctgtaatcccagtactttgggaggctgaggcgggtggatcacctgaggtcgggagttcgacaccagcctgaccaacatggagacaccccatctctactaaaaatacaaaattagccagatgtggtggcacatgcctgtaatcccagctactcgggaggctgaggcaggagaatcacttgaactcaggaggcggaggttgtggtgagccaagattgcgccattgcactccagcctgggcaacaagagcaaaactctgtctcaaaaaaaagaaaaagaaaaagaaaaatcagccaggcatggtggcacatgcctgtaatcccagctacttgggaggctggggcaggagaatcgcttgaatctggaaggcagaggttgcagtgagccgagatcgcaccattgcactccagcctgggcaacaactgtgaagctccatctcaaaaaaaaaaaaaaaaaaatttagaaaaaaggaaaaatatccaatcagtcttaaaaaaaaaaaaatctggatatttgaaacgtatcattaaagaaatcacttaaaaatttaaaaattctgtcattacctaattcaagtcaaaataaaacacagcatattaacacatctatatatatatatgtgatagagcatatacacacatatatgctctatccaaaataatcactgtaactgaaaatatgtgcactggggaacaagctggaaaataactatatatattttccaacaataatacagatttaatatgctttaaaacgaaagcaaggatttggttccagctgacaatcttaatttggctctttgggagaaaataatttaccatatgaactgcgaatcttataaaattacctaatagttcatggcaaagatcatgtgtcaaaaactctttaaacatgtctaaatatttctctttcaagatgcacaaagattctctatgaaacctaacaagaaaagaggtgactgtggaagacactgaggcatgccaatccagtctccaaatttagtacagttgtccctctgtatccatggggtattggttccaggattccctgcagataccaaaatccacagatgctcaagtcccttatagaaaatgtcacagtatttgcatataacctacacatatcctcctgtatactttctccctttttattttttgacctagcagggtggtcttgctctgtcacctaggctggaatgcagtcgtacaattctggctcactgaagcctcaacctctcaagtctctcaagtagctgagactacaggcatgcgccatcatacccagctaattttttcattttttatagagatgaggttttggctatgttgcccaggctggtcttgaactcctgggctcaaagccatctgcccaccttggcctctcaaactgctgggattacaggtgtgggtcactgtgcctggcccctcctgtatactttaagtcatctttagattacttgtaatacttaacacaatataaatgctatgtaaatcgttgttacattgttttaaaaacaatgacaagggaaagagtctgtacaagttcagtatagatgtttttccaaaatatttttgatccatggttggttgaatccacagatatagaactcatggatacagacggccaactgtacctctgctgaagagataaaacaattttaaagtgaaatgaattactccttcccccctaaaacagctgattttcaatcttcaacgttttggttctattaacttgcttataaaaatgtcacactctctattaagacataaggagttagaaaatcactttaaaaataaagttgcttgttgtacaggtactaacaagcattttctgaaatggaaatttgttttttattaacctaatacaaataaggttcaagcactgtatttaaatatttaaaagatagaggagtttcttaaaataccacatatggtgctctttcttgtgagcttgcttttctccacaatttggcaatttgcttcactctagtagtccaatctgcaacaaaagaacagagtataacactttctcagagccatgctaatgatgtgttgtaataaagaatgttgatgaactgctgacagttaatcttattcaggccgtattctcatgaggtcatagacctatattaagttttttacaaagaacaaagatcgtggcacactgtaggccaaacaaacgttttctaaatgaagtgctgccttattaacaacgtagcttgtaaagttgggaagtttttagattcaagggacaaagtagcaaaaatgcaagccagacataataaattccctctggtggtaagacaccaccagaaccaaagtacaagtttgtaaaacatctgtgctaaacagaaatctatcaatttgacctaccagaagtaaacaaagtcataaataagcatctcactagcatttgtggacaacaaacacatggaaaagtaatgagttcaaaccatttatatgaaactcagtgtcatgacggtatacaaaatgaagaagcctgggtaagatcaacagttaatgataaatacagaaattatttattccacattacaaaaagaaagcaagcttccaaaaagccaatgaaaatgaaaaatcagttcacagaccaacagctttaacacagtatttcatgaggttcttgaatcacaaagtaaaattattaaagaaaattacttttaaaaaagttacagctctgctgtaaggacaatttgtgctgacacaaaatgacaacatacccatgtacgttcataaacagcaaatgtaagcatggaaagaaagtggctgaagaatgggatactgccttcacaggtctccctgcatcaaaccactgatttctattgttagataaaaagcatttcatttattacaatacataatgaataaagtcccatgaagacgccaatccaaaaaggtacctaaatacaggggtcatccaaatgaaaagtcacttccaggtacccctctagtaatttaagagtttgtgtattgatagatagctgggaaactattgcaaaactgagtttgaataactttttcaatcctagtttgtctgataccatgaactcaaaataataaaaccgcattgcttgcatatattcaataattgacatttcattaatccaaatttctcattcactggttaatcagaattttcacaaactgtactattatcatctgtttttttcaagaggcagtggtaatagctgggcagtcagggaaagtgagaggggaagaagggaagacaatattgaattcgtttcataaaaacactatttaggattcactgatttagcctagcagtatttttgattaaatgatagtttgggttctagaaattttttaaagaatcacataacacggatttctgcatattaataagtactgctaggagctgaaaaacggaccatttcactaattgaaactaatttttgggaaatatgaggatggatgcagggtctaggacaaagtaaaatgcaagatgtttctagacatctagggaatcttcatgttgtgggtcatcatagacaaaaattagttaagctacctttctattgcagttaaaaaaaaaaaaggtattgcacatgtgaaaatgttggtaaaacagaaataatatattcatggcttaccagggaattcttcctttaagttggggaaattaatattggtgtagagaactggggcaacagttgccatttcacccagagcctcctctttctcccacttaagcgtgcttctctgggcattcgacattgtgtcattttctccttccacagtgggagctgatgatgtccaagagttgttaggatcacttgccattggattaaaggctgaatttttatccctgggaaaaaataaatatctttactttatgaacataaaataacttcttaatatatgttcaagtatagctttcattaaaacctattacaaaacagttaaaagtaacatatttatagcaaaagccacaataaacgcaacatacaataatatcatacacaatcatttaagcagactaatttatatataaatcaaacagaaattagtgcaatttaagtttccatagaaaataaggcttgtacctggcatcaggataagaggattgtgcaattgcagagaaagttcccagtccgcttccaggtggcaaagaattatgtgggagatgaggactggatccaataaggccattcatgagaggcatccgtgaaaaagcatcttcagagaaaaaaataattccgttggcatgatattcacaagtaacaaggagttgaagtaaagctggcccttgaacaacatggtttttaactgcatgggtccacataaacacacatttttttcaactgaatgtggatagaaaacacagggaaacccatgcatagagaggaccaacttttcttgtatgccaagctccatagggccaacatttgacttctgtattctcagattttggttatacctgggggtcctggaaccaaagccccaagtacagaagagatgcttatacttctaaatcaaaacctttaatgcaatttaaaagtaggatttttttcagtattttataatacttaaagagtgacttttggctataagattttgaaatatgatctctacagctgtgattatttcattattgtgtactagaaatagcaagtgttctggagtccaaaagcccagggtgtgaacctcaattttacctgttagaagcagaatcaatttctatttctgtaaaccgtaggtattctgttatttgggttaattgagataatgtatgtacagctctaaacatagttcctggtatgcagtaactattcgacacaattaactcctaaaaaacactaatgaatcacagcaaatgctagtaagttttatcaaatattctttctcttcattaaaaatttacaaacagatgtttcttatattttattcctgttcctcttaataccaaaaaaaaaaaaaaatctatgattctttcctttttttttttttttttttgtttttgagatggagtctcactctgtcgcccaggctggagtgcagtggcaagatctcagctcactgccacctctgcctcccaggttcaagcaattctgcctcagcctcctgagtagttggaatcacaggcacttgccaccatgcccagctaatttttgtatttttagtggaggtggggtttcaccattttggccaagctgatctcaaactcctgcctcaagtgatccacccacctcagcctcccaaagtgctgggattacaggtgtgagccactgtgtccaccccacctatgattcttaaattgatactttctctaaattagttttgagtaagcaatatatctatcactaaaaatcagatgattattcctaaaaatacatacactctggttttggcctaatttttataacttacagttcagcccccaaacacatttgaattctcattcgagcttattcacaaacatcaaataccttatcgttttctttctgaatagacattaggcaaataaaaggaccatcttatgcttctttacaacactcctttaagcatgtaactccagtccttattgtgaaagtctacttgtctaaactatttggaactaagccaactgtccatattggagcagtttccagaaaaaagaaagaacaacaacaacaaaaactttgtttaccttcaaaaagccctcccaattaaacttgatgatttgtggaaatacacaaggcctctgttaattgttgcaacacttagagccatactattacaggagatccacatcaccaattaattacacaaatggcaatacagagttgaccaatacttggtataactagagaattcctaacctgatcacttgatttttttttatctaatgtcattccattagattaaaaaaaaagtctcatacacgtacattttacaatgtataatgatctttcacttaaaccacatcatttgaatgttacaacactaaaacctacatagctccagtatgtatgtgcagatactaaggatgatcactgacaagtttaaaagattttgtctcaaagacttcctagaactctctgactttcacaaacgggcttaccctactaaatgccacagctgggtccactggatcaggttttcacaatgacaaatatctcatgacacttacatttactccaaggattaaagggcaagatttctgcttttttcaaactagaatgccacatctattttcaacttcagtgaaaagcaggttccattaaggcaggggtccccaactctggggccacagactggtaccagtccatgacctgttaggaacccggccgcacagtaggtgaacagcgggcaagtgaccattaccgcctgagctccacctgtcagatcagtggcggtattagattctcatagaagcgcaaaccctattgtgaagtgtgcatgcgagcatgttcctatgagaatctaatgcctcatgatctgaggtggaacagtttcatcgcaaaaccattccccaacccaccaacctgggtttgtgaaaaaatggtcttccttgaaactggtccctggtgcgaaaaaggctggggactgctgcgttaaggaatgtgcaattttaataaacaatatcaaatgtctttcatgtaattaggagaaacaagagtttattgacaaggagaatgtgatccatactgtagctaggtatcagtgccatctaccgatattacaataataatcttgtaataatctacaatattaacatattgaaacttttcccaatagtaatattagctattatttgttaagtactttatgctatgctaagcactgtcttaaaagctttacagcttcatgaaaacccactgaaataggttattatgttcagctccatttaagcaaagaggacccacagaaattaaataatttgttcaaggacaaataagtaaaagcaaagtatttcttcttattttattcaagaagtggtcttttttttttccaagtctaccatatctacccaaactagtcatattagtttataaaagttcaaaagttacttcacaacttttacataaaggtatttcaagttactctatctcaatcttgaaaattctattctctactttctgaactttattaccatcagacaataaagcatattacatattacataataacatattacactttgcctcccctttctcatcaattctattgaagttactccactgaagattagcaacaaccttcccatggtccaatgaaacaatgtttttcaagtagtcatgttacttaactgtacaacctgtctctaatgatcattcatttccaagatcctatacctctcactcaatgtctcaaatctctcaccactttttttactttcacctaacctttaaaaggaagaaagataagaaacatgtaattgcacacctaatataaatcagatgagttaagcatatacttaattacatttaattaaaaagcattcctcgagattctatactctactggcagtatattctcttaataaatctcatccttcccacatgtgcaattagcacaattacacagataattcctacattttcatccatctccttgactaactgcaactgcctgtaagtcaaaatagtgtatatgtcccatttctaccaacctaaaagaggtctaaaactaaattcattgtacctccactaccttctaccagcacacacactaagtcttcctctgtttcatgattatcctctgggcccctggtttatacatagtctaattcactttaatttccccctttcctcacaccttatatccattcagtagcacagtcctacttgttctaatgtcattttctctcgtatctattccttcctttcaatcagcacggaagtatctttacatggaacctactttttaacttagtctcaaccacaataacctcattagtacaattcttctcgtcccaaatttattcccaatattgacaccagagctaccttagcaaaacacataagtgatcagatcacaccagtggtgtaaggtcttcaaaggctcttggaagcctctagggaaaaggctagctgcctctgcctatttctcagagccctttacaatcagcaccaatgtccacttctagttttgcttccttaaacaatgcccactccctttgctctggaaaacattaaagttgccattcttgaataactatgtgtcgccctatatgtaacttgatcatgctttgcccttacattagaactactattccttcaaacaagaacaatgaaatcttagtgattcacaaggctgtacttgaattatactgtactataatacacattagttgtatacctgaaagtctacagtattagaattacaaactcctaagggtaggcaacctgattcaccttgtattacacattaacaccttgcaaaagaaaaaaaaaaaaagaaaaagaagtcatcctcccaagaccttttaaaaatgagactgcacaatgaagtgattttcataatgattgtaagatgttttttataaagaaatacatctttgatttttaaaatatgcactttcagttcagaaaacataaagacaggtcatttttatatgttgaaaagagaaatactgaatagttcttaatcgttaaaacagcatatgggggctgggcgcggtggctcacgcctgtaatcccagcactttgggaggctgaggcagatggctcacaaggtcaggagtttaaggccagcctgaccaagatggtgaaaccccgtctctactaaaaatacaaaaaattagccgggcacagtggcaggcacctgtaatcccagctactcgggaggctaagccagaagaatcgctgaactcagagggcagaggttgcagtgagccgagatcacgccactgcactccagcctgggcgaaggtgtgagactctgtctcagaaaaaaaagaaaaaaaaaaagcacataggaacaattaaggcaagaatagttatatgataagtatattacccaaatgtaaatcacatgtttagcctagcaaaaatcaaggtaaatttatgtttagaggctaaactggtaaaaacacaaatatttccattatgtgcattatggaattttcatgtatatacaaagttgttagtaaaggttacaaattattcacacactttggcacttacacaagaaaaggagaagatatcctcatgttattcaattcagggtatagtcatgaggcagtgacaataggatagagagagatgttcctatgctcaaatcatcagaaatatatactagctgcgcacagagggccacgcctgtaatcccagcactttgggaggccatggtgggaggatcacttgaacccaggagttctagactggcctgggcaacaaagtgagacccccacctctgcaaaaaatcaaaaaattagccaggcatgatggcgtgtgcctgtggtcgcagctgcatgggaggctgaggacagtaggatcgcttgagcccaggagatcgcagctgacgtgagttgtgttcacaccactgcatgtcagcctgggtgacagagcgagaccgtttcaaaacaaaacaaaaatacatatagatagagttatatacacgccaccatgcaactccataaactccttcctatagattcccatacctgtaccaatttccctatctactcatacagaccttaatcctaggctatcaaatttcagctctacagaaaaggggagaaattggtagctagttgtaagtaggcagaagaaaaatgaacaaaataggcaaacattcacaaaatttcatagtgtctacagggatagaaaggtcactgatttactatgaaagtatgtactgaacacatactctgtggcagggcatataagcaagacatggacaactctagcctttaaagagctcacaatctaaagggaagacataattacccaaacaggtattatatttgtgccatatgctacaaatgaaaaacatgggggtggggtggtgaccagctaacctctgagagatgacagtgaaaccgagggcagatcaatgagtacaggcagccaggtgagcggggacagttccacacacacacacacagcaagtgcctatgtggcaaatgactagagtggagtgagctgggaatgggacttgcagggagggaagagggcaggcactgttacatcctccccactggacataaggataattacagaattacagagaatttcagggagaccgctatgtgaagtcagtatttttcaatcattacaaaagggtttttctccctatcagtttgtatacgtggctactaaagaatagggcaaaacttgcttgtgtgtgtatatgtacccacatatatacacatgtgtgtgaatataatgtagaattataaagtcataacataccctgattgtgtattggcaacagctgtgttggtgggggaggctgtggcaatggagttggctgagtgttcgcaggactaagtacagctgtaaataagtcttcaacatcttttccgccaagctctaggagataaaacaataatagtaacaagattaaaagactagtagggtcctggtatggggaacgccattttcattaactagaaaatcaaaacacatttacctggaattttatataattttccaagaattgctcctagaataaattaaaaaaaaaaaagaaacattaacagctactaattcaatatactgatataaaatagtatttaactgacagaaataattagaagttaaattataaccatgcaaaaatctttaaaaatcatatttactcaggtcttttagaaagcctagatgtagggcaaatattttaccatctgtgaccattttgtctagttcaggactgaggatcccatctagctgttcttcacttaatggtcgtgaactctgattgacatttggctgaggcaaagaggaaggatcatcagtgacaggaccaatatctacaagagtaaggaaaataaatttaaaggtacattcagaatactcacacaaaaatgtatagcactatttacctgtacttagtatataacaatatgattaaaatagagaaataaagtctgtaattctgaatcagaattctcatatcaatttggagagtcgctcagtaaaaattaggcacaatatatttgtattcggtgccatgtaaagttctatttcaagtaaaaacatttcctgaggaataaaagaatacatctgattttaacttgccaactcctgccaaaaaaaaaaaaaagcttaagataggagtttatgagaaatcgatatgcaaataattgctttaatttggaaaatagtgttatcaaatgtacagttcaattattatgcacagtatgtaaaaaggaatatgtttcatatgaattaatgaaaagccctaaaatgctcagtgtttaatattatcctttgtaaataacttcaattataggtaatatttttaaagtattctataggcacattctgattatgtacattacattttataaaattgtaacatgctgcagctcaaatttgtaagagtcacatgtaaaagtggtttatcatctacatttttttcatgctttctcaatattattactattaaaaagtaaaaatttagtctgttcttatttgatcttatattaggaactagctctacgacatttaggtaatattgtaaaccacatattaacaaaaataaaattattcattaaagaaaaactactgagaaagtcacccgaagtacagtacagctatactatgctttagccacacacaaaaagggaaaagcaaagtatggattagtgacaaattagcactactgataaacagcatgcacctacaggttgtttcagctgaaatcactataaaaaaagaagactacttctagtcagccgtcatccattgctcagtttcttaccaaatggaaaaggtgagctctcaacctggaaagtgcataaatcaagacctataagacccaaaccaaataaaatggatgattaccacaggagcaggaagtgagggaaaatacaaacaaaagaagaaaaaagatacagcaagactttaaggcaacatgccttaaatgtgatgcaattagaaagacgacagaaattaactaacttgctatacccctcctaaagcaggaaagctgaggcagatcaaagaaaatgctgagtcctttaacaaagccaaaaacaaaaacacagttactgggaaacagacaaaaggctaaacttgttccacacatcatacacctctcgctcacatcagaaaccagaaaaagggtaaacagtattcatatatacctgaatgatcaactgattttgctagatcatctgaaattattccaagaatgtcatcatctgtgtttaaaacttcagaaatatcagctaatgggtcatcagcaggacctaaatatagtaaatatgttttttaaaatttcagtattttctcagatattaagccatttgctaaaaacctagagtacagcagatactgagtgaggcaagtactggaataaaaacctgagactcttaattttacagtaaaaattttccatagcaaaggagataatgttttgaattacaaaaatttactaaaaattcagacgattttgtcttgtgactaatgtatattgagacaaaatttaaagacctgtaggcaataaaagtgaaacagaataaatgctgtaagaaacaaagcaaagaaaaaaaagtttttcattaagaaagtggcatgtctaaaagtgacattgagaaattaaaacacagtaggaaaagttaaaatatgaaagacaaacctgtcactctttagaaattccatatggagcacaagccagaaattccatatggagcacaagccaggtaccatctagtaactacttgcagctttgctgttcatactgattactcactcatttattttaaaaagtatttcactacccacagaactgtgtctatggatcacgtatcaggcattgcccactcagtaatgactgaaacaaagtgcctgccctcagagggcttactttctcagggggagttagtaaataaacgacatcgctgtaagtgctatttaaagaaaaaacaaggaaaaaggattaaaaataagctgcggggatgttgtattagacagagtggtctatgaagacctttaggagatgactgagcataaaactaaatgagggagtaagttatatgcacaaagatggagataaccctccaaactaaggcaaagcagacataaagcccctggggcaagccgggtttgccaacgagaggccagagtgttaacagtaagaaaaactgtggtaaggataaaaaagaggcagctagggcaagattatgttaagattttagagattatggggaagactgggttttattctgaagtgtaatgagaagttgctgggaggctgaaagataggagatgactaatattttaaagggaacatactggctgctatatgtagagcagatgaggggtgggaattagagaggggctggtaagattagaaaagggcactggtgcagtctgagaggtgaggtgatgacagcaccagggttctaaggaaagctgagacaagtggtcggctttgggacgtattttgaaggcagacacaaacgtggatgaatgaaagggaaagaaaagtcaaggaggattctacgggtttgggcttaaccaagaaactattggaactcttgtttaggctagctttaataattatattagtcattcagtaaagagaaactgaaatttttaatccatctcaagcttatttttacttaaaagggggaggagggcataaatgtaatattccaggtcaaatacttctgtcaaacagtcttggtcccattatatagttttcaaaatgtaattcatatgtaacatatcacattaagttttgcgtgcccaaatatccaggaactttttagagaaaattatttcaataatgacaacactgtagttgaatgaaaaaaaatctggataatttttttaggagtcatatagcagttttttgttttaaagtaatggaattctactatacaattataactaattttttaaagactgttttacaagtttgcccctacctaaaggattttatatctgaataaatcattaaaattgatataataggctacaatgaatgacatgttaaaaaaaagcctttagtcattaattttccattataaagtgaaaagagtagttcaattgcaaagaacaattaatctaggttttgaaatgggtatatttttctagtcctccaagttttggccttattgtaaaactgttctctcttcagtatttttgtggaaaaaaataaataaagaaaaaaaaaaacttgtatcaatatctttcctatatgttctctgtccaatttcaatccttttgcttttaaaactcaagtgcaaagagctcctatttaagtcttcaaagtggctagttatgagagttataagataaactttatcgtaaaatatcctttgaaggacccacaggtctttcattatacattatttttaacaacatactgacaaggacaagagcaggtcatacttaaaacaacagaattaaagtaggaggtaaaaaatatgtaagattgaacaaacaagaagcatgacctcactaccaacaatgaggcagactggacatgcacatgtgtccaacacggggtaagattgcttctaattatttcaaaaagtcaaaatcaaaaatagttgtcagtatttcaattcaggataatgccaagttaatgaagcattaactacttaacatccaaagtcatttttcagtggaagattgctttaaaattgtttttcaaaatgagtttataaaattaactgagtaacaaatgcaattaatggtaaaaaaaggaagcttaccaaaagaacaatgatttacaattgacagaaccataggggagaagtgggagaaacactgatcaagacacttacctacccaatgagttaaactcctagagccttgctgacattgctgtaactctgtaaatacatcaagttctcatacctttctctgattgttaatagttcctgcatttaggataatggttctcaaccgggggtgattttgcccaccaaaaccaaaaggtatttggcaatatctggagatatttttgatcatcatgaggccaaagatgctgttaaacatccttctatacaccagaaaggctccctcccacaacaaagaattactggtgcaaactgtcagcagtaagaaaccatgacctagggcaacagacttcactgtagtaacacagtatgccagcaagttcccaagtacccccacatccatttcggtttctctgttttgaatttaagctgtatgattaacaaaaatctatcttagatttttagtcaaaaagtcactgttggccaaattataacccctcacattgccctcagcaaagtgtaaaccaaatgttttccttcacaactcttgatgttggtactagttacacaggtaaattaatttgctacatcttatacacctgtccacttaaaatagttccacttactgaatgtaagttatacttcaatgctgttgatttttaaaatgcatatgaggccaaacaaaaacatttcaaaaagatttaactgaaaggaagatgtatgttatatgatataaagaaaatatctgtgaataattctacataccgtgagttccagattttgttggagccgaggatgaactaagtagtggatctaaggaaggatccaagaaacctgtgttcatgtttgttttatataaaagctgagctccatcttctgacagattatctaaacttatcttgctttgtctacttgtatctagaagatcttttccaaagaaagcttcctagatgaagataagcacatacaaaaatggttagaaaattctaaaaagacaatagattattctgtcatggtttttgacaaggaagcagaaataacagaaaaggtttatatttaacaatatagaaactgaatacagaagtattaaaaaatagaaatatcctgtcaattattttatatagattctccttattttaaaaataagattttttggtagctttactagagacaaaattatggaaataaaaccacacaattataccaaaggtttctagaaactgcagaatagcttcatgagtattattaatttttatagattacttgcagaggacagcataagactttgatctacggctttaatatttacttcaggtagatttgtaatctattgattcatataaccacacttacactataagactacttacatcatcaatctgaaagacggttttatagtcagtttagccatactatgtgtgcaatatttacagctactaaaggcttgtggttttctatttatttaggcatattaacatttttccatttcaatatactttcaagctgggttccttgcaactccaagatctctccaaaatttctcaaaaatcaataccaaagacaaaagggaagcacagttccacccctttaccctgcttcaacccaggaactctgctttagtctatatcctatgatgtagtctatctggaaaaaggatcctccatacaggacaattttgcaatacaacatttaacacattcttgccaaacatgcacaaaaaagttcactgtagcatattttgtaatgtcaagaagtaaaaatggccttaatgtctatcaacaggcatagaactatccaaattatagacacttatattacaaaatacaacaattttttaaaagtatatagttctatgttatcaaagaaaaagccctaaaatacattactaaaagaaagtaagttgaattacacatacagtaaattataaaatacaggtcgggcgcagtagctcacgcctgtaatcccagcattttgggaggccgaggtaggtggttcacttaggcccaggagttagagaccagcctgggcaacatggcaaaactcttgactctacacaaaacacaaaaattagccaggcatgcgccaacatgcctgtaatcccagctacctggaaggctgaggcacgagaatcacttgaacccagaaggcagaggttgcagtgagctgagatcacatcactgcattccagcctcagtgacagagtgaggctgtctcaaaaaaaaattagaaagttcaaatcaagactattataagtttgcaaaaataaattataaaaaagtttctgaaggacaaatgccaaattattaacaatactaccctttgagaaaagagattgggagtgtgtgaagtctggtggaggcaatgatatatctgatttgaaatgttcacattttaaatgaaaaagtcatctcactatgaaaaatctaaaaattcacaaaactagaataccaggtagaagaggattcatttcttataataagcaatgcttttatcattagaaaaaatgatgaacagcagaaagcgttttagaagtttagaggtcatttatttaatgccttcagtataaatctgagaaatcttacaccatcatcagcaagaattctgtctaatgactcatgactttactggtgtttatcaaaaactgtgtcacccttattaatttagtgtgttttacattccctgtagataacataaagagggggctccatccatatcgtctctaaaagtccaagaaaactaccattaaaaaggcctccctcatgtcacacatacagacacagacacacacacacacacacacacacacacacacacacacgctgaaagttactgatgtgcaacaggggaacaagacggcccaggagactaagatcacagcagtaattgggaaattagacctaataattttaaagactcttttgccaaagtattaaatggctagttttcatacttgcagaaacacctaaagaaagcttcttaaatttatattacactttacagaaggatcaataggaggaaaagtaggttgccatcacaatattcctagaaaggactattaagaagggaggtaaagggaatcccaggagaaaacaacaacaaagatgaaaaaaaaaaaaaaaaaaaaaaaaaaggtaagccaacctataaatggattttttttcctgaccaattaaatgatcgtttaaaaaaaaacaaaggtgcaaacctaggatataagagattgaggggaaaaacatgtatgaaggatatacaaaaagtaaggcacaggctaggcactttacatacatactctcactgaacttctgagcatttctgagaggcaccactatgtcacaaatgaggaaaccgagacacaagagatgttaaacagaacaaaatcacacagctaactggtagtggaatggtgtttaaatcctgactttataggctgagctctaacatgaatactgccattaagatgttagtagctacaaaaaagaaaattgaggaagttgtatgctagttgaaaggcaatgtattttaaaaccaattaaactagtaatacctaactggaaaattgatgtaaaaaataaatgcaactcaggcaatgaagggttatctgtgtaagccatagtttcttaggaggaacagatcagatgaatagttgtctacaatgaaatgaggatggcctctcaatgatagtctgttccagttcaattttaacacatgaagaaatagaggccaggaaggatgaataacacgcttaggaatttacaattagttagatgcagagccagatatttaatctcagtacaatttctaatattgagctgtttccgtatcacatggccttaaactctgacttaatgtttacaagatgaactagaaaaaaattttttttgtagtctacatctatcaaacataatttattcgtactgaaaggtatttttctgatgtgtattttggaaaacaaaaagaatactgcttaaatctttggttctccaggcctctaaaagtggtaacgattattaaagctataactttggctgaaaagcctatctttaatcaatgaatataattaatgtaacttgtattggcaaaggaaatttcaacagaacttgggtgtggggtatacatagctatcaatgacttggaagattgagtttttcctatcccaaagtgtccttgttacatcttatagaatgcttagaagtgaacaactggtattaaaaaagcaatttatgacaagtatcaaagcacacaaaaaaagtaaatttaatttttatggacccctgaaaggtaaaaatggcatttatgatgactaaatgacaacaaaacaagtaaaacattaacaaaaacaacaaacctatgttttaaaactcaatacattttatttcctcaattaacaaaccatgtaaaataatgtaaagcaaaatattacttgtaaataggcagggaaagtttcttcaagcttatttttcctttttcggtatctcttctttattttttcagtgctttcagtaacagaaacagattcatcaactaaagtatctggtaactgctcactccagcctgaaacaacagtcacatttataaatatgtgacatttaaaatttctagacaaacccactgaaggtaattttataccttaccaacatacacacagtttcatataaacaaacaagctttttgaacaaaaaaatctcaaatcaagtttgttacttttaagtgccataaaattttgatttcatgtctacttagtattagcatttttcctattttcttaataatcgattacaaagcaaaaacgtatttatttaaacatattttgttaaagagtaaaataataataataataataataaatacccaaagctcatgagtatgacgaaatggcaacttataaactattaagagaaattctgtgggtgtaacttttttgtagggtgtattgagaatactcaacaaaaaccttaaagaaaaagtgtgtcctttaatacagcaattccaagttcagaaatttattataaattatttgtaggatatacacattgtgaaaacatgacgatgaatatgctaataaatatgcaatgaacacttattcttgaaatcagaaatggaaataaatttggggactatgaaactagcaaagaaacaagaacacagcttaaatttgacaaataaacaatcaaatgatattctcagatgcttcataatggcagggcaaatggcacatcccttctgaaaatcaatatgggcactctaccaccagactacgtaagtgaattgactcttctgaaaactagaaatagacaaacattttttacaacaatctttttaaaggcaccagtaacctagccagaacataaggaatccatgaaaaacaaaaattaagataaataaggaaccacagaagtaagcaaaaaagtaaaagctctccgaaatttgctgaaatccaatgacctcaaactccaattttcagagcattgcgaggaatagggaatagaagacaaagcttaaggcctctctccaaggcagacaggccagaggtgacttgcataaagctcagggtcagtttaataagaaatacaccttcacacaaaccatcacttgccacctcctgctcaccaccaatagcaaaaaaaaaaaacaactcctggctggatgcagtggttcacgcctgtaatcccagccacttgggacgctgacgcacgagaattgcttggactcgggaggtgaaggttgcagtgagctgagacggcaccacagcactccagcctgggtaacagaggaagactgtctcaaaaacaaaattttttttagatatcagctgggctcacatttgtaatcccagcactttgggaggctgaggcaggaggatcgcttgagcacaggagttgcaggccagcctgggcaacaaagtgagaccctgtctttgcaaaaagccaaaaaattagctaggcatggtggtgtgtgcctgtggtctccagctacatcagaggttgaggacaggagaactacctgagctcaggagtgcaaggctgcagtgacccatgattgtgccactgcatgccaacctgggtgacatagtgagacccctagatagatagatagatagatagatagatagatagatagatagatagacagacagatacataaatagataaaaactgaggtgcactgtcacttgagaatttcaaattatatgataagtagctaaggcagtcaaagaaaggctttggagatgaccagaaagtaccttatgtaactaagttattcagtccctaaaccatttatatttaaatatagaaaatatatttaataatttgatacaggaaaaaagagcttgtcaaaaaatctcaaaagaataaagtctattggatttaaaccatttccttataaaacctgattactgtattacagatatgaactctatacgcactcaaatcctttcatcaataaaaggcaataagactcttattgagtaacaataagaggcaataaggctcttattgactgtaacattatttaggatagttttttccaatagaaatatcaagaccaaagggttacattaaaaaaaaaatttttttttaagtcagtactataccatcatctctgcaaggtaactgctcggaaatagagcctgaggaatcttttctgatcacagatcttttggttttcccttgcccagttcgacttctttgccgcaccataaatccaccaatacctatccaaaaaagaaattaggtaaactgataagtaatttctccctacatttccacagtacacaggataaaactgctttatcttgaatagtaagtcattttccaaaattaaatctgtgctaatctaaatcaataacctgatttttaggtaaaatagaagttaaaaacgaccaaaaaaaaaaaaaaaaaaggcaaagccactcttatcacttatcaaacagaatacaaaaagacctgtgtgcacttcctcttctcaacagtatcagtgtaaatatcaaacactaaattacgctggcttatctatttgacaaatattagtgcctcatacatcacataacagtcatgcactgcataatgatgttggtcaacaaagggctgcatgtcaaggcagtggtcccataagattataatggagctgaaaaattcccaccacatacagacatcaccgtagttataacaccgtagcacaattactttatttttttaaatgaatttagcgtaccatacagcctaaatgtgtagtaagctataccatctaggtttgtggaagtgcactctatgatgttcacgcaacgatgaaaatgcctaatgatgtatttctctgaacttaagtgatggatgactgtctgtatattaaccggctaactggtacattagctggaggatagaaggcacaaactacctagatgacacaaatattctttgactgatatgatttcagggggacggtgtctggtactccaaggtatgagggcatttatacatgggacacatagagccctgtgtttaacagcatggaatctggagtcagactatgtaattctgcttactaaatacttctcaatgcctcagttctttcactggttaaaaaagggggtgaggcaaagcagcttctcatacacatgttaaaaggacaaataacataagtgaagtgcttagaatagaggtctggtacacagtcaacactataagcttttgtgaaatgatatcgttgtctagcaatttactccgtgacctaatgggtccctcaattagagggttgacttccatgtgaggcagaggaaaagaaaaaaaaaacggtaaatacaagttcctggaagaaatctgcaatgtctaaaaaagtacacttataagcctcatgatcaggaagaaatgaaatcattttcataaaacaattcagaagcaactaatcttaggtccttattatagatatgacctatttaaaagataggttatcttttaaggtctcatggaatacgaatgaagtaagaaagttcttccttccatatcaaaagggatttagatcactcttaccaataaaatataagcaataagaagcataaagattgtacaaatccaatttaaaacctcattggtaaacaagatattaataaactgcctaaggaaagcctactcaacacgtgtgataagcgggaaaaaaattttttaaataaatacataaaagcctacaacttctgtattgtgacaattttaataattttttccaataaggcaaataaaactgacaagcaagaccgcttttctctccactcctgaggcagataagaaatgagtgtttaatcagtcatggtttttaactggactataaattctaggagccataataactctgtcttattccccttcacactgtatacttactggcactcctgcataaacactgaaataagttttttcaaaaaaagatattagaaagtgaatactgaaaattaaaagcgttacagaagtacacatccagaggaactatataaatggccttcaaagtccaagtatgaacaaaagccaatctagtaaagcctttaataaaatggttaacatttgggacaaggcattcaataatgattcattgtgaagtattcacacattcaaaataaagaactctagagctaaaaagtcgtattcaaatagtttagttctttaatttatgtgcacatatttttgtttagacagttctgaagcctgaatatttaattttaattgaagtcttcagtattgtatttttctttaattaaccaagtgttgatgatattgaaatgtctacctcaggcactatacctggtctgtatggtttcctttttctctttttgacaccatctgttccttccactcccttagtttcatcatccacagcttcccgctcaggactagattctgattttccatcacaatccataagttctccttctggaaaaaagtaaatgtatacacaaaactggaaaaacctatcaaatatataatccctacataatggggaataaaaagtagggttgttgctgagccattttaattgtacatccctgttggtagggaaagtatgaaaggagatagaagaagccccaaatggttgtagaaattgtgctgcttagtgcagtgttcccatgaaataaaacataatcagagaaggggaacacagaactcagagttctgttaagtgcaatccatttgcacttaacaaattcacttgcttttaattatgtcttcaggtccaggtctctagactagaactctcttctgagcttcaaccacagctataattgaatattacctagttactgaaaactgtatatccaaaatgaactactaatttaaaataaactttctcctttttcccatgttacctatcatcattaaaaggcatggaaatgtaacccggagaagacagaggcctggaagaccacctcaatcattcctaatctctttcctcctacaaccaagacttctcaatacctctgaaatgcattttatcactctctactaccatcttagtccaacctcagatgactcactattaatacaacatgctcctatctagttccccaccttaaagcttacctctctccaatcagttctttaaattactgcataaatgatctttctataaatatgtatccattttctgcttaaaatcctttcatgtcttcccaatgccctcaaaataaactttaaattgcaaggcccattacaacagtctcttgtaaactttccagcttcatctcactcccaccagtgaactacactcagttctttgaatgtatcaagctctttcttccactatcttccccaatttctgccttctacctaacttatctttcaggatttattctaaacttcactgtattaaagaattcctgatatttagaaaagattatgtcaaacagttgtatgctcctatgtattaatgtcatgctttatttttattggttctttaaaatctgtgtccctgctagactatattctccatgagaacaggtacacagattttcttagtaacagatgtattgttagtaggatacctaatacatgttcaataaatacttcactgaatgaggtaaatggaatgcttagagaatgctattttagagaatgctattttaacactatggtaatcaaacttttccaagttatatatgctttacattgtattacaggaaaaagacatgtttatcaaatacattttaaaatcaagttgttaactccttcaatattctcagtattagagataacatatttcagtaatggcatgaacagggtatttgtcttttgttttttattatatttggtctatatttgaggccaattccataacaatctgataatggctatcggcttatgactaagccatgaaaagaaaagtttataggccaggcacggtggctcatgcccataatcccagcactttgggaggctaaagcaggtggatcacttgaggtcaggagttccgtaccagcctgaccaacatggtgagtctctactaaaaatacaaaattatctgggcgtggtggtacacgcctaaaagcccagctattcaggaggctgaggcaggagaattgcttgaacctgggaggcggaggtttcagtgagccgagattgtgccattgcactccagcctgagcagcaagagtgaaattccaactctcaaaaaaaaaaaaaggccaggcacggtggctcacgcctgtaatcccagcactttgggaggccgaggcgggcagatcacgaggtcaggagatcgagaccatcctggctaacacagtgaaaccctgtctctactaaaaaatacaaaaaattagccaggtgaggtggctggtgcctgtagtcccagctacgtgggaggctgaggcaggagcatggcgtgaacctgggaggcagagcttgcagtgagccgaattggcaccactgcactccaccctgggcgacagcgggactccgtctcaaaaaaaaaaaaaaaaaaaatgacagggaattttgagttaagatggcagactaaattcatatgttaaaattacattctcctgaaaccctactaaaaaacacactgaaataatctatttttaaaagataaaatcaagctgtggcatggtggcatgccggtaatcccagctatttgggaggctgaggtgggagaagagaattgcttgagcccagaaggttgaggctacagtgagttatgatcacactactgcattctagcctggacaacagagaaagacccaatctcctttaaaaaaaaaaaaaaaaagacaataggaaaggagaaaaacaacttaacaaaggcaaattctcagttgagagcagaaagaactgaaaaaaagaatccagtttataacactcctcagaaggctgagaaactaggaaaactggccacctttggaaataagtgggagaaaacccaagcaacaagagatttaattatctgcagaagtcatactccctacatctgcttcctaggtttacacactgagaagctgctactctcatttgtgggatgcaggattcctgggtgaccttaaatggaacaatgggatgaagactgaaaataggaccaagaaaatatgggcatactaaatgtggacaaccccatcctgctcccgctgccagaccccacgtttccccactgaattctcagaaagctagcagccagatctctagcctccaagtatgaggtttgaaaagactgcagtggggaacctgagcagttcaagaagaacatctaaagatacggaaaccagagggttcaccaaatggtcagcacaaatcaccccactaaacttacaaatcgacaagcaccaccacatacagaaagctttctaatcaactacttaattccttttttaaaaaataaaaatactatctatccagtctccatctttagttcttcacttttaatcatgcatgtaccataaagattatccgactatggtctataacaagcttgtccaacctgcagccaagatgctttaaatgcagcccaacacaaattcataaactttcataaaacattatgagactttttatgagtttttttttttttaaaaaagctcatcagctatcattagtgtattttatgtgtggcccaagacaatgcttcttccattgtgggccatggaagccagaagatctgcaacacccctgatctgtaacatgaaagacagagacctgagaacataaaagacaatttggaattaacagactaagtaggaagaaaaaaaatcttaaaaaagattaaaatcctctgagggataatataagatacccatgaggcaagaataggatgctacaaaagaaacattcaaagggaggaaagaaagctcttgaaataactgaaatagaaataaaactcagtagaggaagataaaataaggacatgaattggaaagaagcagagaaaaactgagtatgtttcacatctgaaaagcagaattctggaaaaacagagggaattgttatcaataatatagttcaagaacatttcctaccactgaaggatataagacagcagactgaaagagaccactcagtgcctaacaaaacagattttaaaaatcaaaaatagacaaaaacagacgttatcctcatgaaattttagaacactgaggacaaagaatttcccaaaatcttaacagcttccaagaaaacgcaggtcacatagagagaaccgagttcttcatatactagaaactaaaagacagtggatcaattgactaaaattgataaatgaaaatgtatttccaacctggaaaagatgagtcaggtaggaaggtaaaataaagacattttcagaagtatataatgctcaaaacttaccttccacacattctctgtcagggagctatggaatatacgttccacccaaatagagggaaaaaataaagagaaattcatgaaattgcagaaaacacatgtaacacaggagagaacagaagatgatctccaggatgatgaagaggaaatccccaagttaatcatatgtaatggtttgtggccaaggataacactggatctagtacaaaggccacctttcacctgaaacaatgcacacaaggacagtaaaaaccaagagagcacttttattgatgaggttcatagtgacaccagtaagcatacatgttgagacaaatggcataaagtagcacatacagtgccctcacacaggtggtatcactgtaggctaaagtctcttctaaccaacatcttcacaagggccttctgattcccacaggctgaaataaagaaaaagaccgtatcggccaggcacggtggctcatgcctgtaatcccagcaccttgggaggctgaggcgggcggatcacgaggtcaggagatagacaccatcctggctaacacagtgaaaacccgtctctactaaaaatacaaaaaattagccgggcgtggtggcaggtgcctgtagtcccagctactccagaggctgaggcaagagaatggcacgaacctgggaggcagagcttgcagtgagccgagattgcgccactgcactccagcctgggcgacaaagcaagactccatcgaaagaaacgaagaaaagagaagagaagagacgagacgaggacagaaagaaagacagacagaaagaaaagaaaaagaccatatcacccaaatatgagaaattctcccatatatacatacttgtatctagatgactaatctctggaaagctataagaaaacactggttctttccaaggaagggatggtcaaaaggtaggctaacttaacactgttcactctttttaagacctctgtatttcttgtatcatgcacaggtattgcctattcaaaaacaaacctacaacagggaaagactgaaagcttttcttcaatatctgctacaaggcaaggatgcctactcttaacacttatattcaacatagtcctagccagagcaatcacataagaaaaggaaataaaaggcatcagcagaaaaaagcgggtaaaattatccctgtgtgcagatgacatgatcctgtatgtagaaacccccaaaaattccacagttactagaataaatgaattcagtcaagtagcaggatacaaaatcaatatacaaaaatcagatgcatttctttatacaaataatgatctgaaaaaaaaatgaagaaaacatttccatttaaaataacatcaaaaagaataaaacactgaggaacaaatttaatgaaggaagtgaaagctttatatactaaacactataaaatattgacaaaagaaactaaagacacacagccgggcatggtggctcacgcctgtaatcccagcactttgggaggccaaggcgggtagatcacctgaagtcaggagttcaagaccagcctggccaacatggcgaaaccctgtctctactaaaaatacaaaaattggccaggcaggcgtggtggcaggcacctgtaatcccagctacttggggggctgaggcagcagaattgcttgaacccaggaggcggcagaggttgcagtgagcggagatcacaccactgcacttctgcctgggcaacagagcgtgactctgtctcaaaaaacagaaaaaaaactaaagacacaaataaatataacgatatccccatgtttgtagattggaagaatattgttaaaatgtccatactatccaaagtgatctacagattcaatgcaatccctatcaaatttccaaaggcatttttcacaaaaatagaaaacacaattctaaaatttgtattaaatcataaaagaccctgaatagccaaaagaatcttgagaaagaaaaacaaagtagaaggtatcacactacctgatttcaagttatattacaaagtgatagttaacaaaacagtatggtactggcataaaaacagacacatggatcaatggaactgaatacagagcccaaaaataaacccaagcatatattatgagctaatttttgacaagtccaataagatacaatagggaaaagatggtgtcttcaataagtagtggtaagaaaactagatatctatatgcaaaagaatgaaactggacctgatgcctatcttacacatcatacataaaaagcaactcaaaatagattaaatacctaacacctgaaaccataaaactcctagaaggaaatataggagaaaaactccttgatatcctccttgacaatgattttttggatatcacaccaaaagctcaggtagcaaaagcaaaaataagcaagtgggactacatcaagcaaataagcttctgcatagcaataaaaaaaaaaaaaaaacaccggggtgaaaaggtagcacagggattaggggaaaatattggcaaaccacacatctgataaggggttaaaatccaaaacatataaggaactcacacaactcagtagcaaaaaaatcccaaataactggattttaaaataggcaaggacctgaatagccatttttccaaagtcacacaaatggtcaaatggtatatgaaaagatgctcaacatcataatcatgagaaaaatgaaaattaaaaccacaatagatatcatctcatgtctcttagaatgactattatcaaaaaggcaaagacataagtgttggtgaggatgtgtagaaaacgaaacctttgtacatggttgataggaatgtaaattagtatagccattattgaaaacagtatagagtttccttaaaaaaaaaaaaactaccaccataagatccaacaatgcctctgttgggcatatattcaaaggtaataaaatcagcatctgagagagacatctgcactcccatattcatggcgacattactcccaatagccaagatatggaaacaaactaagtgtcctgatggacaatttacttacccattcaaggacagatgaatggataaagaaattgtgacgtgtgtatacacatatattaagtcctcccttaatgtcatcaataggttcttgggaactgagacgttaagctaaatgaacatacagcaggtcctcaagtaacactgtttccttcaatctaattttggcataatgcaaaatgaaaaaaaaatcagttttgtcatacttttttccccctcttaaccacagtttctaagaacttactgatgacaatgaggactttatacaatggaatagttagctttaagaaaggagacactgccatttgtgacaacatggatgaaccgggaggaaagtatactaaataaagtaagccagacacagaaaaatactgtatgatctcacttaataagcagaatggtaggcagcggggtgagaagctgaacgtatagagagtagaatggtggttatcaagggtctggaggtaggggatgggtgggatgggcagaagtaggtcggagggtacaaatctgcagttaggtaagacgagtaattctagagatcaaattaatacacagcatgagaaccacagttaataatattgtaatgaaaatttgctgaaagagattttaggtgtacacacacagagagtaactatggaaggtgaaggatacagacatttgtttgaccatagtaatcatttcactatgtatacaaagcatgttgtatacctcagatatgtgtaataaaaataaatgaaaaaaaaaactgtatcctacctgccaaaaacagttttaaatgcattatgtctttggatttagcaaggaattcacctttgcaggcccacttacatacaacattataaatataccaggtgattcattgtactattcacagtaaaagactgaaagaaagccgagcgcggtggctcacacctgtaatcccagcactttgggaggccgaggcaggcagatcacgagttcaggagattgagaccaacctggctaacatggtgaaaccccgcctctactaaaaatacaaaaaaattagccgggcgtggtggcaggtgcctgtagtcccagctactcgggaggctgaggcaggagaatggcgtgaacccaggaggcggagcttgcagtgagcaaagatcgtgccactgcactccagcctgggcgacacagcaagactctgtctcaaaaaaaaaaaaaaaaaaaaaaaaaaagattgaaagaaacccaaaggtctatcaacaggggaaagaacaggtaagttaaattgcttatatttccatacaaaggaatatttgcagccataaaaaaatgaaggacagtaaatagtagtaagacaaaaggaacaaaatatatatatatacacacacacatacacacacaaaatatatatatatacacacacacacacacacacacacatttccttatacatgcataaaacacatctggaaggttacacaagaaacctctgaggtttctggagatgtaaactgggggcatgaaggcaggggaaagggagagacttcactgtttaccttttaattattttccaattttaaatcatttgaatgtataacttgtctaaaaatcaaattttaaaagttgagggaattaacattacagaaagtaacaaacctcaaggaagcagccaccttcaccagatggatagtctacctcactcttcccactctccagtagttactgaatgccagtcccctccctccattcagtctgccccacctgctggccttctagagcctcagtgcagtcctattcccacacctcccaacacatccatacactgtgatggtcgatctgggaccaccagttgagaggaaatgtgttgtgtttccactcttgagacaaacagagtgttattttattgaggtatgggatttttttcttgcattaacagggtttctagatcccaggaggtgaatgagaaagaagtatgcttttattgcataaggaatttgtttctgatacaccaaagtgatgatgtatgacttttcttaaggaagcggttattagaagagttaaaaataaatagaaacaaaaagtcataggtattgttccaatactccaggaacatcacagtttggattctgtagatgtgtgtaatataatgtgtaatattacattctgacaacctcaagttgaaaactgcacagctgaagatcacttatagtcaataatacttttcaaactttaattttaaattcatcaagtctctccctaatgtattgtactttttaataaaggaaactgtcagatatgctataatacagaggaaaacgtttatatactctttcattataatttttccacaacttccaaaatgaagaaaaagacatggaaacattaagctcatagaataattgtggcagacaattccctcatcctaaaagttcaattaccccaacacaggcataatttcttactaactcaaaaggaactgaattcacatataaagacaagcatgggattctgttgagttctgttggacacaagacacaattgctcaagcactggttgagcacttgtattctaatagctcacggttactgagcactccatgtgtgggaagagccagtgctgggtgcctggcatgcatccttgcacctcatcagcacaactatcctatgggctcatcctggttcacctattttataaatgagaacactagcatcaaagaagttaaaaaatttgcctaaaaacacccagagtaggtttcatcattgcccactactttataatgttttcccaagggtactgagacattatcaaaacacgttagtgaaacagtctaaaacatcacaaattttaggtttaatacaaaatacccagaaaagggcagtgttattagaaatctcagcataatgtaataataagaacttacgatgattgtattctttccctattttttctcctgtacaggcatatgaaataccataaaacttattttaggggtgtgtgtgtacatgtagtttcaggataatatagtaatctaaaacatttttaatatggcaaagtgtggcaatactgaatttttaaaagggatttttatttagcaaacagaaagcaaaaatgttgtccaagtaacatgcacttattttatccctaggaatgtacctttccttctgcaaaggatgtgagatcctggcacgtaaatgaacatgagggactagtcatgaaaatgctgtatattcaattccttaaattctaaaattgtcttagcatttaacatccaacacactaaacaatcttttttcatattcaataaaaataaggacaaattcagtaaattcagatgggctattttatcacgtaaattttaaaaaagcaagggtaatttttcaactgattttcttttaccctgatacgagtcaatgagaaaatatgaaattgaaacatatcaccatttctcagtttacaagtggtagtcacaaggaaaaccttccaaggtcttttgtgttgtttttaaaaggtattataatctcataatttgggaaacaatgtgtactattatcaagaaacctttcatattttgtgaaatggagcacttcccaaatttaagagactatggaaacctttttcagacattttttaacatcctcagaaatggaaattcttgttaaagctgatctgatcaattcctcctaagtatatggactacttctttgcaaactccaactgcccaaatcaaattacctgttcaattgtatctgaaaatcagttacatacaagcatcagaaagtgtttctcccagtaacatagacccaaaacacactacaaaacaaaaattatcaagaacatacaaaagacatatcttttcatttatttatttattttttgagatggagtctcactctgtcaccaggctggagtgcagtggctcgatcttggctcactgcaacctctgcctcctgggttcaagcaatcctctgcctctgcctcccgagtagctgggattacaggtgcctgccaccacacccagctaatttttgtatttttagtagagatgaggttttaccatgttggccaggatggtcttgatcgcctgacctcaggtgatccacccgccttggcctcccaaaatgctgggattacagattataggcatgagccaccgagcccggccacaaatgacataccttttcaaagccacaattacctctcacctggaccattgtttctcactgatctacctgtcataactcttgcacctaatcatctatttatatcataggagagtgttcctcttaaaatataaataagatcatggtgttcttcttttcaggaacattcaatggcctcccattccattgctattaagcacaaactactgacacatcaccttatggttgtgtgagatatactgagccgtccttcttgtcctcacatctctaatcttctcaccttctgactgtcccctctgctcactctgttggtctccacaacactctttcttcaaacatgctcagcacactctcacccagagcctttacatcggcttcctcactgtctgggatgctcttctctcaggtaatcaagtggctcactcactcacctctttaaaatctgtgctcaaatactgctttctgttcatatggaccctaaacacccatctgtacttccaattcctttttttttttttggagacagagtcttgctctgtcacccacgctggagtgcagtggtgcaatctcagctcactgtaacctccgcctcccaggttcaagcaattctcctgccttggcctcccgagtagctgggattacaggtgcatgccactgagcccggctaatttttgtatttttagcagagaatgggtttcaccatgttggccagtctggtctcgaactcctgaccacaagtgatctacctacctcggcctcccaaagtgctgagattacaggcatgagccactgcgcctggccaggcaattcttatcaaactttatttttaccatgggacttgccaaacacattataattaactgattttttttaagagttgggttacctaacattaaaatataaactctatgcagagaattctacctgctttgtacactgatatgatttccaacatctgacatacagtagatattcaataaattctattgtctcaaagccagctgcagtggcgcatgcctatagtacctgctacttgagaggctgaggcagaaggatcacttgagcccaggagttggaaaccagcctgggcaacgtaacaagacactgccccttaaaaaaaaaaaacaaaaaactatgaaataaaatataatcaaacaaataattatcacttcatttctgaatcagttgaaaataaataaccgccccaaaaatgagcaaaccaacagtaatcctctttaactcatattggattttgggttactattaaaatattttgctatctcaagaactcagcaggctgagcagagcagatggtttgagcccaggagttccagaccagtctgggcaacatggcaaaaccccatctctacaaaaaaatacaaaaattagccaggcgtggtggcccgcatccatggtcccagctactcaggaggctgaggtaggagggtcgcatgaacccaggaggcagaggttgtagtaagccaagatcgtgtcactgcactctaacctgggcaacagagcaagaccctgtctcccaactgaaaaaaaaaaaaagaattcagctagaaaaaccttatatttactttgatcaagaaaatgtttataaaccaatactttatgatgcacactggtgaatatgaagttatacctgaagtaacattaaatgacagcttttccatttctagaatgtatgcatcaactaccttaactgaaacatggtattatccaagctcacagtatctgagaaggtttgtgtcgttatctagcaaactaaagtcaagccctctgtagttccccacctgtgatcttcaaagatatggtgctccttgagatttctgtaaggtaggtctgttctaaaatgtgtgaaaggaagagaacctgaaaaggcaaggtctaagaagatcactcatttggaaatggcaagggtcagtcacatcaggggttaactaagtcagtgtgatttaccctttggtaaatcatacacatatttcaaaagttactttatatgctttaattcttgcacacatatttcatggaaaataaattagtattacctcgactatcatccatttcaccatcccttgaatgctctgattggatgtctggaggggtctgaaggacggccacgctattctgatttataatcttcaatttcaattttggttttgaccgttttcttcttggaactgtaactgtgaggctctgtaactgagtcatccctgattcagtcaaacacacaccatcctgggtataagtcttgggtgggtctaaaattacaaaatcccaaggatacaaatttaaactttcatttcaaatttgactgattactgttccaaaatacccatgtcaagggaatgtgactgtagttctagaaagcaattacgtatctatgaaatgcatgaataattaacttcatgatacccaataaaaactatgaacaataggtcaaatttccttggattacaggcagaaaggttgcatgtttttaaaaaatggtcttcctgggccaggtgcaggggctcatgcctgtaatcccagcactttggggggccgaggcggcaggcagatcacgaggtcatgagatcgagaccatgctggctaacacagtgaaaccctgtctcttctaaaaatacaacaaattagccaggcgtggtggcgggcacctgtaatcccagctatgcgggaggctgaggcaggagaatcgcttgaacccgggaggcagaggttgcagtgagccgagatcgtgccactgcactccagcctgggcgacagggcgagactctgtctcaaaaaagtcttcctggaatttctattttcatgtcccaataaaaagagttagaagcactgcaactaaatgcaatgctcagctaatccactatgagcttcttcgtagaaaagatcaaaaggcagggatctatttacgtaagagaagagagaatactccagaagctcatctggaaaaatcagagtatcaacataattactaatagggagaagtaataaataagtacaaatcctgcagatttaattttaaatgtacaaaactgttgttccttagaacaattcctgtactatccaaacatttttgtatcaggtgctattaaatacaaatattcaaaagaatgactgtttaataagaatatcatatgaatcaccatactaggcttattaattattttaaaaattaagagattgaattaattctaaaagaaatctgttcgctaactaggccgtgttttctgctaactgataattaagcacagtaatatatcaatgaaactaaagcaagtatggcattaatggttattctaagagctgttatttttgttgcctacttgctgaaatttataggaatactgccccagtaaagctggatgacattttatatatcattgtggaaatgattaccaacattacagaatttggatagaacacccatatgattgaagcaggtttgacaagtggtaagccaattatgtaaaaattaagcaaagtaaattaattaaatcaagtaaagcatttcaaattttacctagctcttttacttttgtgacaatttgtgctacaagtgaagattcacagcagtctgaggaaggcactgaaacgaaaaaaaaaaatccaggtaattcttttcagaaaaggtaaagtgtatttaaatacttatatatgattataatttctgtttctatactcattttattaaaataaatgtttgaacactaaagttaaaagtgctttttaaagcaacaacaaaacaagaagtgatgaaggaaatactcaagtcatggaggaaaacctggctaagaaacaatcaacatattggattctgacatattgtcaataactacaagatcatgttccttggaagcaaaattatagtttacatctaaagtatatgctttttattgtttcatgtaaattgttttataacaagttgtgataagtcatgtataaccaaaaataatatttttcataaaatacttgtcaaagtaagtttcacaaagacaaaatagagtagagctaagctaattcattggttatggacagtaaggtgcaagtgagtggtacaagagtgcagactcacagtttaaattattctcttaccattagacgcaggcatatagggtctgcacatgctacaatcaaaaccaatgtctgctacattttccacttcttcctcagtatttaagttctgacaaactgcatgcatccatctaaaaagaccatatttgtacattttttttaaaaaatggaatatactgagaactgctaccttttaaaacctgtaacactgagtcttcaaacttaaaagccctaagcctcacatgctcctcctaccttgcccttttctcctaactatctctattaacagaaaaactttcatacagctaagaaggaaataaaaaggaatgagaacaactattagagaggaagcaaagcacattacataaggaagctaattattttatcatcatatattaaatatttcaaagacagaaaggaagctagttagggcaaacacaaaggtattcagaaaactgcaaatggcagtgctagcaggtatgtgctccaggtaatgcatctaacttgaagtagacatatctcacggaaagcgatgttgaatggtaatcgggaaattaagtaaaaagttgtcttgcaatggaacaaataattagtagccagagtcccaagaatactgtactactgataaaataatactattaataatatatgttcacttcttaacttctaaagagtacaacaatataccaatgaaagcaaggaaacattcttgattatgaaattccacataattacgtagggagggcagaaggtgctatctaatatctagatatctagtatctagagctttaagaaaaagtggtttaaggagaacagaatgtgttagatattttttataatctattagaagattcagaaacccttcataagaaacggcatagatgaaggcaataattctccatctaatttcaagggattcctaaaccctcaaaaaggcctaaattaaaaatctttagtcttgggcgggcacagtggctcacacctataatcataaaactttaggaggctgaggcgggcggtcaaaagatggtcaaaagatggagaccatcctggccaacatggtgaaaccctgtctctactaaaaatacaaaaattagctgggcgtggtggcatgcacctgtagtcccagatactcgggaggctgaggcaggagaatcgcttgaacccaggaggcggaggtggaggttgcagtgagccaagatagcgccactgcactccagcctggtgacagagcaagactctgtctctaaatttaaaaacaaaacaaaacaaaattttagtccggagttgagaattcaaaacaggaaatcgcttctgtaagtttctaggtgactaaaaatctacaaggcaaaaagttctgtacctaaaacttgtgattaaggaaaagctattttccatttgtttttttttttgctacatttcaaagagaaaagctttaaaaagatgaaaaaatagcacaatacctatcacattgtctacattgcagaataagatcttcttctctatagtttcgatagcagactggacaggaagataagcttgcacaaggagcgcactgtgtgtaattgttctgccattcacatcttagacctgcagatgttgctccacagtgtctgcaccaaacacacctgaaatccaaatccccccgaaaagtctcaattttattttcttagttactcagttactgtaattcaggaagctacatacgaacataatgggggaaatgatttaatgtgtatgtgaaaatttttctgattactggtatctatcatagaatatgtgtattattcaattaaataggtgtggctaatttttaaaaaccaaagtggtatgagaaagctctgaacttgaaagactaacaaggcaaacaaaccctagagtaccatttgcacttccagcctcctttgggaactgtctgcaatggagggtctaggcagtaggtgtgataacttatgtcacagtcatcacacagcaggagtcttcctgggtcagttgccttcccacaggcctcacacacagtgcactcaagacacctccaacctttgctaagaaccactttagtgatctgtaaaagaaacaaccaatccatgtgatttatgcattaacctaacataatcaaatatactatataaattaatatggtgcttatgtacctagaagcagaaaagaggcaatcaactaacatttattgagcacctacggaggcccaatactgggttgggcatgttcatacacgcttttagaagcctactgagcagaataatagaaaatggcacatattttaacgcctttttaaagtccacataattaccttatgctgtacatttaatgtccactatatttatagatatagtgaccagattttaaagaaatcaagtaagcttccctattattgatacataatttgaaaatacatcaacaaaatctccatctacatttccatgcttagaatcaatagaaaaaataccaaaaaaattaatgtaaggcatgagttcttagggacattttatgatcttagaggatttctatttagactatgaagctaggaattctgaagttcacattcactcctctgtttattctcccctctctcaagggtataagttagtagaatatttgggaatctccaaatccctaataaactcctgaaggaagccacaccatgtaatattaagattgtggaacttcttaaagatctcaaaagactaggatcctcagacagaaccaatcaagtgcccacattataataaaacagcaagtaatgagggtacagaataaaaattcagatcatgaggtacatgaaagcctaaaagctaccagagaagaaaataaaagagttaaattcaaaggaacacccatcagaatggcaccaaacttcccaactccagatgctagaagagtataagtttccaattctacaggaaaatacttttcaaagtacaattctcaacctagctacacaagcaactatgtgtgaagacagaacacgttgtagacacaggaagactcaaaattcagctccctcattctcctttctaataaagttacttagagatatgcggaacagaatgaggatgtattataaagaataggaagacttgggatctataaatcaacagatccaacaaaggacatcaggccaggaagtttaaggatgagaacaacatacctagaagccactggcacatatcagagcaggagaagggaatgtctagaaggagggtaggacttctcccagaaaaaaacagtactttaaaaactaatcttatatgatagttctagagtaggcaaaaacaaagaacgaatggagagtcactattactttcttgttataaaaaactccatgaaagacaaaagaaactcatagtatactgtttagacctgcagtgaacatttactgagtcataaccaacaccttattaattgaactaaacatagtaatacaactatattgggagaaggatggaggtgtattttaagacctaaatcagaatttatttattcatagcagaaagtcaacaaaatctagcattgataaagcagtaaaccagttgattatttagagctatagcattaaccacaagaaaaaaagacctgaaaagattaaaagcgactgcctcagacgtggaggtagagtaagacaagagttggttgttcattacaaggccttttttttttttttttttttttttttgagatggagtcttgctctgctctgttgcctaggctggagtgcagtggtgtgatctcagctcactaaaacctccgcctcccatgttcaaataattctcctggctcagcctcctgagtaactaggactacaggaatgagccaccacacccagctaatttttgtacttttagtagagatggggttttactgtgttggccagactggcttgaactcctgccctcaagtgatccacctgcctcggcctcccaaagtgctgggatgacaggtgtgaggcaccacacccagcccattacaaggcttttaatgtcatttgatttttaaacatgtatatttattattttgattagcttattgatttttaagaatttgtcttagattaccaagttaatgtattatttgcccaaatgaaggaaatggcctaggggtaagatcagggtggcttatggcagtagccagcaaacatttccaataaagggccagagagtaaacagaaagttttgagggccatatgatctgttgcaactttataaaaactctgccagtgtaatgcaaaaaccgctacaaatatatgtaaacaaaagaacatggccatatttcaataaaagtttatttgcaaacacaggaaatgggccagatttagtctatgggccagtctgcgtgaccctggcttaaacaatgacctgaagataaagtggcagacagatctgaggtgttcagtggcagaattttaaaaatatttatcttcattcctactaagttttcttcacagatacctgtggtcccttttataaccaaactctcaagtttctcagcttatattcactcttcaaaacactacagtctggtctctacacccacatccactcataactgcttaagccaggcttgtcaagaccttcttattctcaaatctaatggaaacattagtgtttgtgtttcttgacttctagtacttcaacacttcaacaatttctccctctttgaaatttccttttaacctaggtactggggttgtactatcatttttttcttccgttgaaccagtctagccttagttttaaaagttttttcaaataagatgtcatccaggattccatccatggtaccatgtccaaagttgttacagatatgttttataatctaatacggatacacgcttcaactataatggagtaggtgggaccagcctgttctcccataagatagtagaaaatgggacaaagtgtatgatacaactgttttcagatattggacaacacatagtacaggagacagtggtctctgagaggaaggaaacactcagggagtcctatgatattctgcctagaaacattttccagaatgctgcccagggagggagaacctcagcagagtacaatcaatggcctcgctgaggttagggaaggcaaggcagtggaatttgcaggacacagtactcaaaatgaagaagcaataacgactaagagctccagaaatctacaaaggatcccctgaagtctttggtggaacaccaagccgtacttctagaagcccaaagacccacaaccaggggaaagtacatctactgggaatttgtaagctgcacaattaccacagcttgcaaaaggctcaaagacaagtgaagcacaaccagtcagagtacaaagacactggtgaacagggagcagaattcagtagtgatcccagaaaggccaagtcttaagtatagggttaaattaatgctaggaccgcagctaccaaaatgtggtctagggaaccccagtgagtctgtaaagttaaaacaagtttaaataatactaagatttaatttgccttttttcactttaattcattcacaattatacagtggtgtttatagaggctacatgttgtatcataatattacattgatattgtacaggttgtgcttctgtagtcttgtgttataaaatgttcctagttttaatttctaaaatgctgaacagtccatagttaaaatcctcataaacaaaaactatggagtccccagtaattttaaagagtgttaaggttctaaaaccataaagtttgaaaatatccaccttagagtgaagactttctagacttgccccagcaagcttaaaaagaagcttcaaaggtatcaaacttatccacaaacaattgcctcctacaataaaaatgcaagctgagccaattcacatatccctagtatatttctagatactgctgtatttctcaatgagactgcagtattctatactgtccaaaacagtgtcatcgtgcaaaaggaaccatacataatttttaaaaacaggaattcaaattctagctctaccagtaactatgtgtttgatagtgcactaattgtccaatcttaacttatgtaagtcgtactcatctgtaaaatgggaattcggtaattgttggatgggttaaaagaaatacattactatcttgaaagggatcttattcaatttccttaggtccaaaacattaagtattctaaaaaacaaaatctaatgatagcagcaacttttatacagaatataaagtacaaagaagaaaagaaacatgttttatgcatatataactctattttttaattggctttatatactctgtgtttttcagtcacataccatgagcaactaattttaaaagactacataaattaaccgtactagtcttctattttggatagtattaattacaatctttcattttgattcctaaactcacaaaaacctgtattaccctataaaataaatactagtgtagttatcaacaaagaattctgaaggagataatgttgatttgcttactatactgacattttactgacaatgatataatacagtgatgtttgaagggcaggggagaaaggtataaaaatcactcatggttcacaacctgttactgaaactgaggttagtatttatattacatggtatggcagtactagaaaagatttccttgtggagtatacagtttaagacctctgctgtacagctatacctccatgcttgcttccagtggccatgacactttattcaaatatgtaagttttattaagactgagttcttaaaaagaaaaaaccaagaaccttagatacaactagtgaagtattgagacctgtccatatttaaaaccaagcacacgataccacttaaaaggttccccagaaagcctctatcctgaaatgcttcaaagtgagcagcgctgactctcgattattaccaattgcattaaatatgacacttgttttgtttcttttggctataaggagaaaatgtcattttgtatacgagtgagcatagaggagagagaatgcgggaaagaacagaatgggctaataattttttactaaatattccagttctcagctttttaaatcagcagacaaaatgaattagctaaacctaaaatctttgtgaatactataaattgtcttttaaattaaatgcatatatttttatgttttactttttcaagacaagtatattgtacaatataagatttatagaggagcaaatttcttgagataggaaacccttaaaagcagtattttaagtatttaaatactgtcacatatgtttaataatcataatacttaattgtgagaactgggagctcatgttactactaaaaccaaataaaaattcaatacatatttgttaactcaatttaaggatgtttaccttaatactgacacagtatggatggtaacactgaccacactgagaacaggcaagtaatcttccttctgctccttggccaaaactgccacaaactacacacatatcctgaagttaagaaaacagaacatattttaaatggagactaagctaaaaacctacaaattttactttaaaaataccttcttaactaatatagctctatagctaaatattgaatgacttctgtgtatatgagataaagcagaaatgtgcaaggaggaattcaatgaggaagacagtaaattgtcaagttcaaacctgattcaaagtgaacttgtcactgctagaaaacaacacaactgtattgtgcatagagttttcttcatcatccttatttgatgaaatatctgcagtagacacctataaaaagcaaaatacacagaatacgaagttatatttttcacttgttttacacttaactggaaagcttcagaaaattcataatcaaaacatatattttggctaaggtctagaataacaattccaaatattaatgctaagatactaccgtaaaatggagtcgtgacattttattattcacctaattctctctttagaggtagaattcctatagaccaagaagtaatgagaaaatataataaacctgtcttagtaagacttgattatgcagaattctaatcaggaaactataaatgataatatatgtatgtacccacacaaatctatcactattttaatgacacacacttgggatctgcaatgtagctagtctgaactgagatgtcctgcaaacataaaatacagcacataattacatattacgtgttgaaatggtaatattttagatatatcggtcgaaatggaaggcattaaaattaatttcgcctgttcactataatctttattttgttttgagaggagtttcactcttgttgcccaggctggagtgtaatggcgcgatctcggctcgttgcaacctctgcctcctggttcaagctgttctcctgcctcagcctcccaggtagctgggattacagttgtccaccgccatgcccagctaatttctgtatttttagtagagacggggtttcaccatattggtcaggctggtctctaactcctgaccgcaaatgatccactgcacccagctcactgtaactttttaatgtggttactaggaagttttaaattgcatatgtggttctcattatatttctattagcactgctttagaatattattttgaataacatcaaaatttcagtattagccatatgattatcaaccaatattgctcagtctggacttagttctatttgactaaatcaactaagtacccactggtttgttaataatttctagagtgattatgaaacaaaacaaagctctgaactagaagctgtagaagaagacaaggagggcattgccaaaatcataaaatacaatcctctttctttaaaaagcttacaacctaagcctggaaagacagagttgaaacacaacaggttatgttcaaggtcaaaacataaaacaactgaattacttttcttgaggaacaactgaaagaagattaaccagctgggtgtggtggctcatgcctataatcttagcactttgggaggctaaagtgggtggatcgcttgagctcaggagttcgagaccagcctgggcaacacggtgaaatcctgtctctaccaaaaatacaaaaaacagccaagcgtggtggcacacgcctgtagtctcagctactcaggaggctgaggcaggagaatcacttgaacccaggaggcagaggttacagtgagccaagattacgccactgcactccagcctgggtgacagagcgagaccctgtctcaaaaaaaaaaaagaaggaaggaagtttggttggttaactaaacagaaggactacatctcagtatttttcaatacaaatacatttaaaagcagtttttttgtttgtttgtttgtttttgagacagagtctcactatgtcgcccaggctggagtgcagtggtgcagtctcggctcagtgcaagctctgtctcccaggttcacggcattctcctgcctcagcctcccgagtagctgggactacaggtgcctgccaccatgcctggctaattttttgtatttttagtagagatgaggtttcaccatgttagccaggatggtctcgatctcctgacctcatgatctgcccacctcagcctcccaaagtgctgggattacaggcatgagccaccgcacccagcctaaaggcagttttaatggatagtactaatgctttataagagcaatttatagtcatatgaaccctaatgactacaagtgttaataatgccaatattcatcattagggagtaagtaaagcaatgacaaatccaaacattagaaaattacgcaacattttaaaagtagggaggtagaaacttgtatagactgccatgaaagaaattatcaaaagacgttgttgagtgaaaaaataaattgcagaacagtatttgaggtatagcactataatataaaaacatgcaaagtcattatatgtagtctatgggcatatataataggttgaatcataagaaattgctgcttttcatcagttcagaaataatattggcaatttcatatggatcaacctaatatataaatataccaaactgataacagggaaataagaaggactgaggagttagtaatggtaaattctgatctacctataatgctttaattttttttaatagagaaaatgtattgatgtgttacatgcatagtattaacaaaatcagctttctaagattttagagaatcatccaagatgattcacaaaagtagaatcatcatcatcagtaagaaattaagtgactactaaaagtaatcattaattcagtcatagaactaatgatgcattgacaagactattgagatatataattatggaaatggctaaaatagagataaagtatctatttctacctcccaaccactaacagaaaattcaacacattatacccactgagcagctcaaagaaattgtaaagatccattattatttttaaaaggaaatttaaccagtgaacgctttcactgaaaatgataaacaatatattcccagtataaaccagaaacaaagtctgcagtagaaaactacaatgtccctagattcaagtgggggtggggagtcatactgtcatatttaaataataagtgcagaaaaaccaaaatattttaaaataattgtccatgcaagaaagaaaatagtatcatctagcttgaagacccactgtttttattttataatttatttcatgaccgttagactgctagaaaaataaaacctaccttgagggcaaaggtaatctttgagaaaatacgtgctattgttgcctgcatagataatagtgtgatttatccagaaggtgatagaaatttcattttcctagaccacagatatgagccaaggagaatagaaagttctgacctaaacttcacaagtgtcccttccaagcagggacacgtaagagtaaacaaaaaaagaagatcaaattaaactcaaagtgagaagataggaaaaaataaagatgataataaaaatcaataaaacagaaaggggaaagaaaatagacaaaagtccatgaaaacaaaggctgactcaagaaggtcaataagattgataaatctctagccagactgatcaggaaaaaaataagacaagatgcaaattattagtatcaagaatgaggaaggtgaaatcattacagattctacaggtattaaaataataagaaacattatgatcaactccattcctttaatttgtcaagatagacaaaatgaacaaatttcttgaaagatgcaaatttatgcaaggagagacagataacctaaataggtacctattaaagaaataaaatttgttgttaaaaactgtcccacaggctgggcactggtggctcatcccgtaatcccagcactttgggagacggatcatctgaggccaggagttcgagaccagcctggccaacatggcaaaaccccatctgtacccaaaacacaaaaattagccaggcatgttggtgcgcgccagtaatcccagctactcagaaggctgaggcaggagaattgcttgaacctgggaggtggaggctgtagtgagcagagatcacgccactgcactccagcctgggcatggtggctcacgcctgtaattccaacactttgggaggccgaggcaggtggatcaggagttcgagaccagcctggccaacatggtgaaaaactgtctctactaaaaatacaaaaaaaaattagccaggcgtggtggcaggcacctgtaatcccagctacccagggggctgaggcaggggaaatcacttgaacctgggaggcagtggttgcatgagctgagattgtgccattgcactccagcctaggcaacaagagcgaaactctatctcaaaagaaagaagaaaaaaaaaaggaaaacacaacaaaaaccccccacaaagaaaatttcaggccaagatggtttcactaataaattaacgtataatataagaagatacatttccactactacacaacttttccagaaaactgaagaggagaatatacttcctgattcattctatgaagctgtagttatgctgataccaaaaccagacgaagacattacaagaatgtaagactacaggctggggcatggtgactcacgcctgtaatcccagcactttgggaagccaaggtgggaaaactgcttgagctcagaagtttgagaccagcctggacaacatagtgagatgctgtctctatcaaaaattttaaaaaaggagttgggtgtggtggcacacacctatgggcccagctacttgggagacggaggtgggaggtcgaagctagagttagctatgatcgcaccactgcactccagccaggaattagaatgataacctgtctcagaaaaaaaaagaagaaaaaaaagtgcacaggtctacaaccatggtgcatccacagttttattaatactcagcaagaaaagggagtacactgttaacaaatgcaacagcacagatgaatctccaaataattgtgctgaaataaatcagtccaaaaagtgtacagttctgtatgattccacttatatacaactctagaaaatgcaaactaatcttggggacaaggacggatggcagggggaatgcagaaaattacagaggggcatgaagaagctttgggagatgaatatattcactatcatgattgtggtatcgttttcaagggtgtatatatatatatatatcaaagcttatggaattgtacatgtcaaatatagcttatatcaactgtacctcaataagcctggttttaaaatttttctttttgaaaaaaggacaagaatctaagcttccttattcctggtttagtagtaaacttgaacaatttcacctgtctcctatacttaaaatgacatttcagaattttaaaaacagaattttaataaaatagcgaagttattacataaaatatttgctagttagcaaatatatttgcaatacacatataaataaagcctcataacatgatagtaagcaaatatctatcaatcttaaaattttttaaataaaagagcaactatattacatactgactttttagagagggttggcatagaaagataaggagtcaaagaggaaggtaagaaaagagaaaggatgagaaagtaaatatacaagaaaacataaccagaggctcaaaaaaaaaagcaaagtaggacagtaaaataaacattttgacctatttatatgactcttaagatcaaaataacttgctatgagattttcatcattaactgacatttagattagagaaaatatacatgaagcaagcctcaccccaggtaatacaacagctccgattccacttttcagctttgacctgcctcggccacctcgccccgacagtcctgcacctcgaggtctccgctttcctggaaatccagacccacggccctatgtaacagattgggaaaagtcaacattctgtgacagaccaaaataatttttaaatccaaatgccactgagataaaacattttattaaatgttacacaaacacttccttagataagtattaagagacctggcttattatttttatctttaaacgtatactccacaacttaaaaatctaaatataaaatgcttacaaccttagaatcataccttaggcctgtcactgtgaatgctatcagcaagcctttgcatgatttttctctttcccactcctacattcttggtgacgacaacaactatagcctgatccagatatttcgaagtgcaacaaattgtattcaatatagagtaagtataaggaagaactctctcattaactggtctcgcggtgattacaataatagctaacatctattgagtacttactatgtactaatctaagtattttttactctcaacaatcccatatagtaggttttattatccccatttgagatgagtgtgctgaggaataaaaaggttaagtaacttgtccaaggtcacttagctagcaagtctggctgcagcgtcccggggttggaagcatattctgtactgctacatcagcgtgaaagttcatttttgctagtgttgtgtaacagtattcttcctctcattaaaattaagtcagtttccttcactattcaacagttctcttatgaactcaacatttctacctcattcaccattgtatttagaggaaaatttatcattattgttattacttttatttttgagacaagaacttgctccgtcactcaggttggagtgcagtggtgtgatcatagctcactgcagcctagaactcttgggctcaagtgatcctcctgcttctgcctcccaaagtgccaggattacaggagtaagccaaagcgtccagccaggaaaaattatttgaggattataggaaagctgacaaaaggctttgtgaaagctttgctttaaataatctgaataataaatacttgaaatggaaataatttatctgacttcttacacaagaaataaacctatgggaaaatgtgttaaattccctgataatttcagacattaagtaccagagtatggtgttccctgccccctcacccttgtttgtactaattaattactccttgaaaaaacctggcacctccctaagtagatgaattatgtatatttaaaattatccagatgctcaggaaaatacttagatgtttccctcacagttaagttaaataatatgtcatatcttcaactgatgtcccttatcatagtttgaaatgaacttattccctatttagcagaatggtttccaagtcaaaaatttatggtgatactgtaagcataaaatagatacacatgaacaaaaggaacgggaggaatggcttttttccctttggatgtaacaaatacagccagctcccagtttcaaactgccactcctgtcttctcttaccctgctctccttgagatcccttttgagaagtgcatcagcttctttgcacaacagatggatggcgtcaggttagttttttgggggttttttttgtttgtttatttttgagatggagtctcgcttctttgcccaggctggagtgcaatggtgcgatcttggctcactgcaacctccgtctcctgggttccagcaattctcctgcctcagcctccctagcagctgggattacaggcacatgccaccacacccggctaaatttctttgtatttttagtagagacagggtttcaccatgttggccaggttggcctcgaactcctgacctcaagtgatctgccccctcagcctcccaaagtgctgggattacaggcatgagccactgcgcccggccgagtttgttttgtttttaaattggtataaaagatttttgaaaaattaagttagtgattaaaaatcgagactacagtaatctctcaatttattttctcgaacatgaaatgctgacccagaaaaaaagtaagtgaaaattggtggtctatattatcaaactgtcaaatgaggtatatttatacctcaatatcttggatgatatcagggggaggtagggaggttaaaaaacaatagttcttccagtcatgaaagaaaataaagtataatctagaattccttaaaatccttgattagtctaaattaaacagccatattccagaatattaaatatagaatatgaagaaaaactgtcatctccagtcaatgaagtattttaacttttgagttaatactttttcaaattaatttttttctcttcaaaatgcatcacactacttaactcacttcaaggactggcagagccatcaaccaatgtcatgggggaaaaagccttgtcattttaaggtattaaccagacaatgaaatatgccacaattttggtatttcttctccatgagaacataataaattaatggagctttttcttttgcttttttctaagcaacaaggttttatgatatcatgaatgaaaaggtccttaattaccttttggtctacatgtcaaggacttctccctcataaaaacagtagtaatcacaacaaaaggaattaaccataaaaagaggtattaaaaatgtatacttgatttttaaatgcaagcatattatttctttacattaaaatttttagatttaaaaagtgtttcttggaagctcaatctagaaaagaaagatttaattcttaacatccagtagggcaaaacaaatcagacagaaatgatatatgaatgtaaatgcaattttatttaccactttgatgctccaaatggcactgccaggaagctgcctgggtttaaaaatttcccgaccttctgaaatgtctggggaccaggaaggtgggctcactgtattatgggtactccaagccccctaggatatggcagttgagaaaatagatgtgtaaaactcagcaacataaaaggtcaaagccagcaactaaggaattttagaacagcaaaaacaaatgcaaacgtatggaaatttaggacaaattgcttcaaggaaggcaaaataagttaatcactaacagtgatttaaacatttaagtataacttaaatgtttgctgctacaatttacattaaatattttattctgcctgagacatcactacaatgaaacattaaaaattaaggtttataggacatcaacattgactcatgaactgcaattactgcaccaaaaagtaaataaaagtcaatcacactttaagaattaacactagaagaaagtattggggggttatttttcttctaacaactatcactctacttaaaaggagaaatggataaccataaggaattctatattctatagctataaacaaccaaaaccagtaggccaaagaatgcaaggagaaacataagcaatcgataaatgcatacacgttaaactgtagagagctggtaacattaaaatgcaaataccattataatctaagcatttaatcactctttcttcagtgaccattagttgtcggtttggttttggtttttacttagggaaatgaatactttatggaaattacatccaatggacaaaagtgaagaaacgttaaagcaaattgtcctaaatttgcaaattaaaatgcctaaagtacctgataaattatatagaaagtagtatcttattaaaatctatataactaaaactaaagcattttacttccaaacaaccacattcagcaataccctgaactaatctgatgaagatgctaaacagcataaagaaaaatgtttactccacaaagataacattttaaagaaaaacaagacaaatgtcaaacaataaaagaatatattttgaattaggtaattcaatggtgcatgctataattttaccaattaagtaaccaaaacttaagacaaggtacatagtacttaccaggtttctagaatatcatcaaattaaaaagtactatctcattaatcacataaaaataccaccaggaattaaaataaccagaaataagaatgtgactactcttggggtaagagataggtaatggaataacagtattttgagaaaagccacacaagcaatagactggtttcatttttaagtcacaaactgaatccacacacattgaagtccagcaatccaactcattctctccagcaaacactttatttttttccctccaggattaccgttaggtgttctttcttacccatcaaatctctaacctagctcaggtaatcactatgctgatttcactgagcagcaaccactgcaggtcaattacctcactttcataatttccaatcaacttgaatctgtacctatgtcttcttccctactattagtaaggaagtgttgtcaaaagccatttctcttttctcattttactcatgctcctgacatctggcatactgttctgctggatttggcagcagtccacctgtggatatttcactgccttcctcgctaatctttcttcatctcctgtacgtgttcttcctctatttgacttccaaagccctggagtttcccagggcttgagcctagatcctaaatggtattatctacaatgagggcatcttggaagttgatgcttcccatattcttatttctagttttaatcaaagatctccaaattagcaggattttcaacttccttcttagcatttccattttctcacacaaaacccctcttaagtttgccatgtttaaaatttctcccttaaccggtttcatcccagtcttccccatccttataaatggcatccagtcccttgtcactctcctttgctccttcagtcctctcccccaacacttcatcaatgcaaatcatcagcaaattcaagactttttatcttcaagttttgtctccaatccttctacttcttgtcacttccaccactagcagctcagtcgtggccaccaccatctctcacctaacctgctacaagagtctactgctggttatgcttctccgaccctgcatctactgaagcctttccccacagcagccagagaaacttttcaaaagtacaaatgtgatcaagcaagtcactattctatttcaaaccttcaattgcttctcagagcacttaaaagacaaacctttcccaatgcctttctccaactaaccttgtggcatttgtctccccgctgctacgctccagctattctggcttccttgctgtccttcaaacatgccaagctctttatcaatcagagcccgactgactcagaacacttcactatatcattccagcccctcaataaatgtctggcattttctttctttctttctttttgagatggagtctcgctctgtcacccaggctagagtgcggtggtgcgatctcggctcacagcaacctctacctcccaggttcaagcgattctcctgcctcaagtctcctgagtagctgggattacaggcatgcgccaccaggcccagctaatttttgtattttaggagcgataccatgttggtcaggctggtctcaaacacctgaccttgtgatccaccagccttggcatcccaaagtgctgggattacagacgtgagccaccacggccagccatgtctggcgttttctaacccttcaggtatggccttacatattttctcaacagcagacctttccttagtgctcccggtgaaccatcatctctcttaccacaccattagtgcctctcattgcatcaccacctaggacgttttattgtttgtaattttatttagtggtaggcagtgggggcaaaagatacctaaattacttctctcaatatttccattggtttttctctgagatttggctaacatacatcttaaattccttttagtcgatagtttaatattatgttggcagtagacagttctcaaaaatatgagacagaaagtcgtactctaagataaaaataatgttgaataattttatttcagaagtaagaattttctggtaattatgtattattcatcataatttaaaagttagctttgatgccaaaattttatctcacttcaaaaagaagacagactttgtgtaattttatagttctgaagaaaaattatcattatacttagatattctgacaaattatctagtatattccttagaccttaaaactaaaatatagctataattaccaaagtttaaattatccttcagatcttagctttgatcaagaacttacacaaaccactcagaaaaggttagctgcccctgtaatgtatgggctcttcccctacaatccagttgcagcactttttacactgtaattaaagatcatgcccctttctgttcactgctatgttaagcaccctgttcagcacttattgaactttttttctgctgagcatctattatctttttttgcatatgtgtatgaattcatcaataaacaatgaactatgatatgaaacacactaatgcctccaccagtaataacctagaatcttgaatttcttcacttaaaaaaagttactaaaaattactaaaaaatctatataatgcctccttaatctacaaactgaattaaaagcaaaatagttcctaatgtaatcattattaagttgtaaatagaatcaacttgctatcaaatactacagaaactaaaaaaacactacctggcagggactgaatttgaacccaagaaaaataatttaacccaaaaacagtttaatattagcattaagtttctttctgttttgaggccaatttctcaggtaaactgtccaagctagtaagttatacaaggactgtgggatggggaaatgagaacaataatgacacgtggaggataggctatttagaagcaactttctattaaaagtcaaattctattgctggttgttaaatatgatcaaagtcactcttacagcccaagagtactatcagttttaaaagcagccagagaaggtttggtgtctcactggcaaactttacacctccaaatcctaaatcaaccccagccccacactcttccaacatactatgtaaaaccaaggttgcttataaacagtaagtctaatttaggaaaagtgaaagcaatgaagagagagagccgaaaggaagataactggtaaaagaaacaaaagagtttacagtttgtctttttggtaaatataatcacttgtatacagtggagctacagcagcaaacacttcactatttagggaattcttaaaagaagtctcatatataaaattgagttcgatatcaagtagaacaagaaattagacctaatcctgttttgataactacagaaacagctattatcagctttagccttcaataatttcacaatacaaattaggtggcactagcaacagtaatatctccaaaaataccacaacaagcacaagtgaactaaaaggaaagtctggtacttctaatcggctgtgttgttagcttggtgttccaaaggggtaggtattttttaggtttaacactatggttctctggctacttttaaaactgaaagtactcttcttataatataaagtaaacttcttataatttgtccaagagatatcaaaatacagtacctatgttttcatttatgaaattttcttgaaatatttactgtaggctgggcgtggtggctcacccctgtaatcccagcactttgggaggacaaggcgggtggatcacctgaggtcaggaattcgagaccagcctaaccaatatggcgaaacaccgtctctactaaaaatatttaaaaaattagccaggtgtgttgacgtgcgcccgtagtccccgctactcaggaggctgagacaggagaactgcttgagccagggaggcagaggctgcagtgagtgaggtcgtgccacaactccagcctgggcaacagagcaagactcaatctcaaaataaacagataaataagtaaaaataaaataaagaaatgtctactgcaaataatacgtttcataaaatgcttaataaaaactttcaataccatcatgaaagcaattagaacatgaaggtgtctgaactagatcatagtagtgtgattacattcaatatctttctataagacgtgatgatacatacagggtaaataatacaagaagacctaagattattatctcagaatttcctaattagaatgggaatacaactgtgcaatgagagaaatggactgaagacagaaataaaaacaaatgttatgatttaatatgacaaatttaaaatttccactttattttccaccatttttaaagagcattccttacagtattcagtttaatgcatttttaaaaatcagtaagacaagtagcacatttctctagttcagaactccgctttcagggttacagttaaagatgatcctagaagtgcattttaattggtctagggtagggccattagcttgatgttctaaaatctaccgagttgattacaatatgtggcagtgtcaataatcactttcttaaacccaggtcgcaaagtacatacacctataaaaatgctgaaaaatgggccaggcgctgtggggctcacacctgtaatcccagcactctgggagacccgagatggaaggatcgcttgaggccaggagttcgtaaccagcctggtctacacagcaagacccccatctctataaaaaaataaaaaatatttttaaatgctgaaaaatgaaatactaaattatttatgaatagataacttcaataaaagatgagaaaatacaactaggtcattaggacaatttgtatgaaacaatatccaatttgctgtctgttacttctcctaccttatcatgtctaatttttcctcatctttgtgaaatcctgcgtctacaataggcaagaaaacaaaaaacaaaaggaatcttattctattcacagccatcagaaaaatgtgttactattcctgtagtcagttaggttctaaatcatacatttgagatatatttgaaacatgtcataaagaaaataagcatcatatttctcactaaatagcacctgaaatattccatatgaaaggaaaaatacaaaaaactaaactttaattactaacctccttaaaggaaaataattctatatgatttgatatttgataatggatgtccaatacctgagatataaattccattttctgtgtcctaacatctcaccttcagaaaatctccaatattgggttatttggattatatatttaaaactgaatatacttgaaaatgtgaaagatttgttgcagcaacaaatggtttagcaattatctgcattaaaatgtgttccatgaacaacagaaaaagaatatttctacttcagtccttaaaaattgtgaaagcacagccacagtcttagtttgtcgatcttgaattcttttggtattttaatttcaccaataattccggaactgctgtttttatatttctcaaaatgttttgtcttgcatcgtccaataaggcagccaccatcatatgtgaccactgagcacttctaatgcagctagccagaactgatgttttaagtataaagcatcttgttcatttttatactaaatgctgaaatattgttttgaatataccaggttaaataaaatagattaaaatttatttcacctgtttttgtttttttaaagtgtaactacttgaaaatttaaaattacacatatggtctgcattatatttatattagacagcactggcttaccgttctactagttggctagcttgtacctccagataacatctgataatccaatcactagctatcacaaactagatctttcagatgtttcctattaaaatgttcgtttaattttgaagtgaattcctagaaaagctcatataatactattatagaaaatcattaaaatcaacttaataatttgcccaccatgaaacagaacttaaggtaaatctacatttctttggttagtatttactttactggtaaagaccaaagaattggtaatgttcaacaaaatatgaaaatgccagtgatgttaacaaaaaatagctggaaaccaaagaatcttgcttacatcacaatcacagccaggaaaatgcagcttattttacagccaatccccaacgtgaagaatatgtagaagaaacagtaaataaaaacagaagtataatacagaaatgcctaataccaaagaaattcatgtaacagaatactgaacttcagtatttctaatatacggatatacacattcctgctaactgtagaatatttcctgcaagttatggtcccagtgcctcaccaatggaagatctatcttgtactattcaattcatactctccctaataacagcactatattagcaggttcatcatcaagtgaaggctgtttgctagataactaaaaccaagattggaaaactaaaaagctggagggagggaaaacacagcctacaaaatacttacaagagtagcagcaaatgatgaagtagtaacaagaggggcagaaaaatagaaagattatcatcggatttgggaatcaaagacagctcagcaaaatactaggacatggctcatataagatggaataagcctggaaatacacccccctccccaatatttcggaacataaagtctacagaaaaagagtcctaatgtattgaacctggtttctcaattgaaacaaaagtctacaaggaaggagagataagtaaaatttaacaggaatacatatgaagcagtatctttaaagaatgtaaatatatcaaccaaaagtaaatttgagattcaaatttccattggtaaagtcttttcagagtcagaacaacataattattatataactattcaaaacaaaacaaaaaaaaacttactagaaaggagcacaactggtttgagaagaaaaacttttcatggtagagcagaaataactgtcaaggaaaatacttagaaaaaggcatatataaagagtggcctagttttactgcacacgtcttttgccatgcagaaacagctaaatcccatctgacaactactttccctttcgtgtaccttgtctttagagaataaaatatatctgggtttgatatagaggagactaattttcacattaaaaaatgattttcttaaaagcttggccttacagtttaaaaattatacgattaaaatcaatatattattcctataaaaagccaaactttaatccatttaaatcatgaaacttaaaacttaacttgaagcaatttcaatcatgaaacttaaaactccaaattactattgtgaattaacacttctccactatttgttatcttgcaattttaaaaaacacttcagaaagcagcaattttgtaaaacaataaataattcgtacctacagtatcttcattttgccatgcagttttacttaaatctcacttaaaaagaaatggaactcattcttaaagggtagaatgtacatgatgtaaagcagacaaaggaagatttatctttacttactgaaaatcaacagtacaattctaagatttttttccatgaaactactgaaataagtcctacttgaaaaaagaaatcccacaagagttagcaattaataaaaacatcaaaatgagaaattccccagcatggaaaattcctgtcataaatgttgatgtttatccagttaaaaatatatacaatgaataatatcaataaataaatatattagaaggaaataatagatgttagttactgtatacccaaaactatactgtattttaggctctatatttactgcagcacagaactaaaagaatttttaaagttctttctattagaaactattatcaataggttgcatctttatggcccaactgagttgaaattccaaataagatcacttcaaatttaataaatggcattcttcattaacagcatttaaaaaataatggctgaaacacataatcaacattacactgaagttctatctgaagacagaaaaagttgccatccacaccaaagctacacatataccttctgattttatagaattgttccaatatcttttctgtcaatatcattaaaatcaccctacctgtttggaccgaggtctaccaggagaaaattttctcttagtaatagctggtttacccatgccaatttttggagtgactgagatgtaagttgttggcatgatgtttccagcagaggaactaagagctgaagggtaattatgcagcatgtcatgcgaaggcaagtctgaagaaggtgttggggaggaagacacatctgccttgcttatgtctgctgatgatgaaaatgatgactctgtctcagatgataactttatagatttgcctccttggtatgaaacatctttcacacaaccctcaattgtaggagtcatttcagagtccatcaatccagtagaaagttcagaattttctttctgttccttttctccttgtagcctttctataaccaactgttcctcaggacataatgaaatactttcctcatgtggggacactaaggtttctagtggaagagtgacagattccatgactaattttggaggccttgattcttctctggataccactgtttcaggttcctctaacaactgcagttgttcttgctgcacagtgatctggtgtgtaacgacttcaatgttttctgtcacttccattttatcttcaatttgatcttcgccacaaatatgcttcacttcagaagacattttcaggtcttcactatcaacttcattagaaatctgtttttccaattcagtattcactgtatgttgggatgatactacaaaattcagaacatttgttatggcaatgtacaaacaaattttaaattttctaactatagatatataaaacatttggctacactagaacttaaatcagaaggtattcatcaaagcagacaattattaagtgaatgaaagccaaagtacacaaggatttatggattagaatcagccacacaccagaaaacctaatgaaaacattatgttttacaacttaaggatttccaaatggattgaaaattacacaggaaaagttctcatactcattttttagttaagaaaatgaggatcaatcatgttatgtgaggtacctaagttaaaaagtaaagagtgatctagaatgtgtaggcattttctaatagtagatacccagatgtaacaaagttactatagactcaaaagcacagacagaaaagatttactaaccaccaatatttattttgcttaaccatacctgccaacctacccaaaatattctttggatataatccttgttcttcatcactgtctataaattaaaagactaatctcaggaaatctataaacttagatatcagaaacatagtcactggtaaattttaaatcaggataccagtatgttaaacctttaactcaatctcatcaaggtaatttttaagttatagtaaaaagacactgctagcctcatttaccaatcagtgactaaaatttatctggtttttttttttttttttttttgaaacagggtctcactctgtgacccaagctggagtagagtagcacaaacatggctcactgcagcctcaacctcctgggctcaagtggtcctcccacctcagcctcccaagctgctgggactgcacacatgtgtcaccatccccagatactttttttatttttgtagagacagggtctcactatatcgcccaggcctatacatgttctgatatcaaactgaaatctcatcttctttcccactttattgaaagactacaggtagggataaaagaaaactaccaagtaacagatctgaaagtacaaaatatttttaatcatgacctcccccctccaaaaaaaaaaaaaaaaaaaaaaaaaacctttcaagagaaactaaccttctttagatccattgtcaattcttttccagaatctcttaactaaaagatttagttaccgtaatgtatatacatacagcaatcgcaaaaatgtctttgggataaagacattatcttgtaactcaatcaaattagacaatatgaacatactgcttaccagcaataagaagactatctgtgtcaagactttctgagggatgactcttctgttgctcttcagtgtggacttgaaccgctgtgagtaacacatttataaaatctctaaggagtcaaaatttctgtaacactgttccctcaacagtaatttgagtaaagagttttattctactaaatgtcaatttccaatataagcatgaaacattgtaccacttattagtaagttatgaagacaaaattagaagtctttgcactatggtaaaaattttttaattgtctttttctctttttctttaacaactagacctcacaagaaagattatagaaaataattttaatgagagttattatacgtaaacttaataaatttcaaaacatctcagtggctttttatgtatacattataatttttatgtatactatataattgaacatacaacttcacatacaacaccaaagactttcagatgagcctgtgattaaatgtaacaagtagttttcccccaacatggtctcttattaattccagatctgcaagtacaataatagctcttatcaatatttactacaaaaagcttaattgaaacatcatggaaataagtgaaataaccctcaataggactgctgagatgatccaatacagtaaatttttcattatctcagcatgaaacatctcatcatcagcaacagctctacttagcaactacaactaaagaaataaaaatacgaattgctttttaatagaaaatcacttggtcccttaaccaagtaagtacttatgattaagtctagatggtagctgaactacaaatacacgcatgtcctttctcctattaatttgtctaagattattttactaaaaaactcttcctaagtgactgcatcttggcttttactgaagttttagtcaatattcacatatttattgtatatacacattttcttcaaaaacagagtatatccattaaacattcttaccatctggaacaattccaggagtggactcctgaccgttgacatctttattagctgcctgctctgagaataccatttgatcttcagggccttcaacttccatttcattgttataatcttaacaaaaaattattaattctttagctcagaatgagtttttttctttgttcattaagtcaacaattatgattttgtatgagtaagggcaaatcatcaccaaaaatgctttaagtttttcttcagatttttctctgttgaaccacatgtatatttacatttttaaaaaacatgaaaattataatgcatcaaaaggtgggccaaccgtggtagttcatgcctgtaatcctaacactttgggaggccaagacggaaggaacgcttgaagccaggagttcaagaccaaccaggccaacatagtgagaacccatctctaaaacaattttttttaaaaggtaactggcacattattttaaaaggatatttcaaaactaaatactgatggcattctggaaatgaaaggttagtaattaagatgtttagttatccttgaagatgataaagagaagttttacaaaagctgccactcataatgatgaaaatgaaaaacaatctggcgagcagttctatttcctttactctctaagactcatgtttttaacagtaggatactactaaaaatattccatacctgaacaaaatcttgggctgaaaaggtgataattaacttaagaaggacattacaaaactacaacatgcttagagaaaaataacccacattataaagaacaaactaagcaaacccaaagactggggaacttccactgtcggcctgaagaacacaagtgaaggaaagcacactagacccggaattcaaatactaaaaaaaactatcttaagttagattagattttagccatcagattcagagatgaccaagataacaaatacatttaaaggttgagaaactgagaacaagatggaatctggaatacaggatcctctcttcctgattaaagcaatatattggtgatacaatggcacaacattacaaaaacaaaaaatttaaaaaaaaatcattctcaaatttacctgtagtgagctcagctatctccacttcctcacctggctgtaaacgatccatctcagctcccaggtgtttacaatacatgcagatatactcttctttgagctgagtatccagttcatgatctgttggtttgtcacactctaggtgaacccacctgcagtgataagtatacttaaataaaaatttctaacatcgagttattatctaggtaaagagaaggcattgctgaaaagctggatatgaaaacagttaattaagtatgagaggagagaggttagaggagttgctaactgacaaaggttttttaaagcacatttgtgcatgtcactagagatgctgccgtatttttacttgacatttttaagctattttctctttacttttccctattagtgctcatttctgatgtggtctggtcttatcttttgcccatttacttccttatgcctttgagactcaaaaacatcatttaattccatctataacagcaatcagtactgatggaattgctagagtgataaaaacttagaagctgtaagatggtagagcaaatgaccacatgaataaaacaatcgacaaaacaactgaatagaataactatcttcttaccttttgcacatattacaatgaagcatgtctttctgcaattctggatgataacacttcccacagaagggacataagttatcctgctgttggtaacaattgtcacatatcaggcaattgtggtgccactgagaactagaccgtgtgccacactctatacatattctgcaattctaaacaccaggaaaaataaaaacaaaaacagtttgttatgcatttgtaattgtagttctgatgtaaacctttaaaaagtcatgaatcatttgtggattatacattaagcttttattttcatgacactaatttagggtacatgctttttttttttgagatggactcttactctgttgcccaggctggagtgcagtggcgcaatcttggctcactgcaacctctgcctcctgggttcaagtgattctctcctgcctcagcctcctgagtagctgggactacaggtgtgtgccaccacacccagctaatttttgtgtttactaaagacacagggtttcaccatgttggccaggctcatcttcaactcctgacctcaagtgatctgcctgcctcagcctcccaaagtgctgggattacaggtgtgagccactgcgcctggccttagggtatacaccttttaaaaagctgttttcaatgtctgatgtggcctcacaaaatctgcactaaaatctccaggaaaatttaaataagggaatggggatatccaggaaaacatataggtggaagagataaaaccaaaaagacagcaactcaaaattcaaaaaaagaaacatatgctaggagcaggaagtaatttttgtggagtaagtctgctcaactctaaaacaatagcatggccagcctggtgtgatggttgatgccagtaatcccagcactttgggaggccaagatgggaggatcgcatgaagccagggatccgagaccaatctgggcaagaaggcaaaacacctctttctctacaaaaaaaaaaaaaaaaaaaaaaaaaaaaatttaattagccatggtggtgcacacctgtagtccctgctacttgggaagctgaggcaggagaattgcttgagcctaggagtttgaggctgcagggagctcacgccactacactcaagcctgggcaacaatgtgagactgccatggtgggtggggaaacacagagcacggtcaacgccatgtgacttggtgtctgaaaatgtgaaaatatattgctccacatcaaaagtccaatgatggcccttcatgtttttagaatagagagagtgtcctatccttaccaaattagaattgtttatgaagtaaaaggccaaccagaggccagccaaaactacttctgtgcctgtgagctagtcagccttaaaaccctgggtatccctgggtgtaaggttaatacattgtggggctctcattacccaccccaaattttgaatctaaaatatcaataaaagggaactttatctttctgtgctaccaggttgatatgaaagggatgctcacttaaaaagagaaactaccaggaaccatagatcagctagtcttaaagattaaaatgaatgcacttaacaacactgatgcaaaaatcctaaatagctgggcacggtggcacagaactgtggtgtcatctacttgagaggctgaggcagaaggatctcttgagcctaggaggtagaattcagcctgggcaacacacagagaccccatcttttgaaatacatacacatatattttttaaaagaatgtattatcctttatctaatgagaaggagaaaagaaaaacaatcctaaataaaatactatcaaacagactctaataccacattaagaaaataataactatgcccaggtggagtttatacaagaaattcaaagatatttaatattagaaaaatccattaataaagtttaacaaattaaaaggtctgaggagaaaaaattatttcaatgcaacagatgattaaagaaagaagtctttgggaagaatcaaaacccattactaataactcttgagaaagtaaaaatggatgggtatttctctaatgtgaccaacataaatacttcaattctaaaggcaacatcttattttatgggagagcccgagaggcattcccactaaggacaggaaaaagcaagggtgcctattatctccactactattttaacatggttctggagccaatgcaagcattgaaacaaatgaaaacagaaacataagaccaggaaaagaagaaacaaaactcttaatttgtaaacagagttggaacatcctagaaaattgttcaaaaattcaataaaagaattcaacaaagtactaggatataaaattagcatgcaaaaggcaatagaattcacacacacaaataacgagttaaaggatggtaagaaaaccccatttataacagcagaaaaataaatattcaagaataagcttaaatgttgaaaatcagtatgaagaaaattataaaacactcctaaaagacacaaaactagactttaacaaacttgtaaagacatcccttgttcttggttaggatgtcttaaaatcaagatgtcaatcaactctcacttatatatatatatatatatatatatatatatatatacatatatatatatgtgtgtgtgtgtgtgtgtgtgttttggaaacagggtcttgctctgtagcccaggctggaatacagtagcatgatcatggctcactgcagcctcgaactcctgggctcaagtgatcctctcacctcagccttctgagtaactgggactataggcgtgtgccactacacctggctaatttttttgtatttgtagagaggcagtttcaccatattgcccaggtttgtctcaaactcctgagctcaagcaacacccctgccttggcctcccaaagtgctgggattacaggtgtgagccactgcacccagacactcaataaattaaatgtgattccaataaaaattccaatgaggtttttattggggctacatatggtgatcctaaagtttatacagaaaaacaaatacacaagcacagataagaaacctgtgaaatggataagttctgaaggggcccaacattaccagatactacaaaggctctataacaaaaacagtgtcgtactggtgaatgaatagacagatcgatggaatggaaaagaggttccagatataagttcaatcaaatctaacattgtagtctggaatctcaagtcactagggcaaagacagtctttttaatgaatggtttttagaaaactgaatagccagttggaaaaagatactcacatcatacacaaacatcaactccaaatagatcagagatttaaatgtaaaaaataaaacaatgcaagccatacatggtggctcacaactgcaatcccagcactttgggaggccgaggcaggcagatcaattgaggccaggagttcaacaccagcctggccaacatggcaaaaccctatctctactaaaaatacaaaaattagctgggcgtggtggcgcatgcctgtaatcccagctacttgggggagctaagacatgagaatcacttgaacccgcgagggggaggttgcaatgacccaagattgagccactgcactccagcctgagcgacagagtgaaactctatctcaaaaataaaataaacataaaaactgcaaatcctagcagaaaatatgaactcctctataccctcagtgtagggaaaggctttctgaatatgactcaaaaatccagaagcaaaagaagattaataaatctaactccataagaaagaaacttttgcatggcaaaaaaaaaataataaaaacaaagtcaaaagacacataatacagcctggacaacatagtgagaccctgtctctacaaaagtaaaaaattagctgggcttggtggtacacataactcctagctaactcgggaggctgaggcaggaagactgcttgagcccaggtcaaggctacagtgaactatgaccataccactgtactatggccggggtgatggagtgagacactgtctcacacaaataagcaaaaaaaacaagaacaaataagctggcagaaagtatctgcatcatgtaacacagataaaagcttacatccctaacttataaagaactcttaaatttaggggaaaatgccaaaatcttcaataacaggcaaaacacatgaacagacaattcacgagaagaaattaaaactgacccttaaacacatgaaaaaacgatcaacttcactcaggataaacaaaaattaaaactacattgatacaccacttttcgcccagaagacagacaaacattcaaaagctgaacaagtcatcctgttagcaaagacgtaagaaaagttctctcacacatctctggtggcaatgcaaagtaccataagccccaagaaagggaatctgacagtatctaacaaagctacatatgtgtacactcctgaggcaataatcctacttctaggaatttaccctacagatttgtccctgagaattcaaaaacacacatgcacaaagctagggagtgtaaaatcatttataatgcaaaatatcgtaaactactgaaataccaaagcacaggccattggttgagtaacccatagcacagatacacaatggagtgctatgcagctgtttaaaaggagaatgagatctcttgaacttgcctaacttgcctggaagtgatttccagattttattacacgaaaaaagcaacatgcaaaagaacatacacaacatgctaccttcactgaaaataagagcaatatatcttcttattcttagacgaaaaataacaggaggtttaaaacagaaaacaatgaagttagttacttccaagaggttgggagaaatggagtataaataataaacaagaggcagtgacaattctgagtaaaacttcatatagtattgagttttgaaagtatactaatatcttctatatttaaaaaattaaatcactaagaaaagaaaggggaataaaatctattactgagagcaaactgaagcagacttgctttttagattgagcaactgaataaatgtgctgatgttgctacaacccagaatttttattgtagaagaacagacatgcaagaatgagaaggcaaagaattcagtggagaaggacaagaactggaggtactggtgtaaattcattatttctaagttatgcatatgtatatgaatatttatgtgtatatacgttaagtgtaggggtgttcaatgttttggcttccctggaccacactgaaagaagaagaattgtcttgggccacacacaagatacactaacactaacgatagccgatgagctacacacacacgcacacacacacacacacacaaaaaaaacacctcataatgttttaagaaattttatgaatttctgttgggccacattcaaagccatcctggaccacatgtagcctgcgggtcatgggttggacaaacttctgtaagtgtatacacacgcatgtatttcctgacaccacctgctgaaaggatgaagaagcaaacacccttcagtagcaatgagcacacccagcacccattccccactaaaggaatctgggttacttatttaacaatggacttattccagggctggggcacaggaggtataagatgagcttgtaacatcttgttacaccaaaaagtatgaagtgttcaagtaagtggtgagggcacaacaccagcgccagcttgaaggagcaactgacagcaagtatgggactatttcagccaaaaaataattaggtaatgagttgtaaatgattgaagataataggagctcatgagtcagtattaataagtaagtttaacatgtgaaagaagtgttcttgcttacaaaagaaagcagagggctaactggtaaatgcggtgggagtgctagagctggaaatgcatcatttgcaaccaaaacaaagcaggttaaaatggcatcatcaggcagtaagtttgttgttgttgttgttgttgctgttgttgttgttgttgtttttgagacagagtctatctctgtcacccaggctggagtgtagtagcatgagttcggctcactgcaacctctgcctcccgggttcaagcaattctcctgtctcggcatcctgagtagctgggattacatggcacccactatcatgcctggctaatttttgtatttttattacagacagggtttcaccatgttggccaggctgatctcgaactcctgacctcaactgatccacccgcttcagcctcccaaagtgctaagattataggcatgagccaccacacccagcctagggagtaagtttttcaaatctagaaggaaattctgaggaaaagcaagatatttgcatggtcttaaagtgtccttacatactgctttattagatacaaaggagggggaaaagaaattggacaacagcctgaccaggtgattcccatgagggaaagtggaataatgtgtgcttccagctgtgataccctgaggatggatcagtactttgcagtattctggccaataatgcatgcctctcatctaattataaggggatatcaaagacaaaatggggaaatttgtttgaaaaaaagaaaaaaacaagtatatcgagaagaactctattcttcaaaaataccaatgacaaaaactaaatcctagaacctacttggaggaaggggtaggttatgaaggacataagatcaaatgacataactggaatatggctagtacattagataaacatactacattgatgtaagtttaggaagttgatagcaggattgtgattttttaagaatattcctactattaagaaatacatactgaaatggtggtaaaaaggcacaacgtatgtaattaaccctcaaatagtagggggttagggggaatagagacaaaaacacagacacacacacgcgcacacacacacacacacacacacacacacacacacacacacacagagaaagcaagagagggcatgcccagtgacaatgaaatgctaacaactgataaatctaagtaaatgcgacatgggtattatttttattttctccaacttttagagtttgaacttattttcaagtaaaaactttctaaaaacacataacataccaacaaacagacattcttgagataaaaataggaaaaagaaacctatctgacaatgactggtttacaataaagatcctgaaaagattacccccactccagctcaccagggagcagccccaaactagactgacagccctgtgggggcacactgatttgtcccaacatctccagccttcactacagtttcacacacagtaaacactcaaaagttaaatgcaaacaaatgagcaaattatgactcaagactacagagagaactacagaagaatttaacagcagagaaagatgatcactcttcaaatggttcaaaggacaaacctttcaatccatgaaaaactctggtaactatttctgtacttactttgtgttaggcattgtgctgggcactttatagataccacttcattaaatccaacatccctgtgaggtaagtaccgttaaccttctatacactgacttagggaagttaaacaggtagccaaagatcatcaatttagtaactgaaaaaactgcattttgactccacagcataagctttgaaccaccacactatagtcccttcatagaacaggataaaaagattaagtatccaatagtattcccagaaattatgtaattctgtcactctcaaaagagaatagcagattacaaagagcaaattagaaagaagcacaccaaaggggagacagaacaagctgagaaagacacccagaattctctaccagttctcaagataatgaaaaccctaataaagaagatcaagagcaagaacaaaaattatccagtagttactagatattattagagagtgtaaagaaggtaattttttaagtaaatatatttttttaaaaaggtgctggggtggcgtgggggatggggactcacacatctcccaaagctttcaggaagaaaaaaaggattatgattaaattttttaaagttaagatttttcttgtgacagcataaactgaaaaaactgaagaaaatgttttcagagtataagaaagaaaaatttgtaatatgaaacattatactgtgccaagttcttatagcctaaagggaacagtctctttcagacatgtagggtttcagaaaatttataattatttttaaaggaacataaccaagactccgaaagattgagggtaaagttggaattaacagaggaaatatatttttgaaagaaaattgtgacaaggtttataatctaggttaatcaaatcaaacagagaaaaggggaataaaaacttcattttcagtggggaatgggagaaattttatatctttaacatttataatcatttacattcacaaaatgagattctgaattataaatcattgcaggaagtaaaagaagagaaaagtagaaaggaattataagaacaattttgcctcaaaacagccaagcatttcaattacaaccatcaatccaaacagttacctctattaagcttttcaaaagataacatttttataacacaaaagaatccaaaataaaaagatgtgaaaagataaccattcaactgttaaactaacaccctacgtggccatagtgtcaggcaaagcaaaatacctgcccttcctgatccctcaacaaaaaacacattacatagaataaagaacaatttcatactggtaaaaagcacaatatattaacactggcgtgacctacttgctaaataacagccacaaggtatttgtttaaaaatatgataaattgataggaacaattaatagtggtcaattgtaacaacttgttgaatcaacaagtcaaaaaataaggtaaaaggacttcatctaactaaatgaaattaataaacacaaatgctacacctttaaaaagtcactacaagtatcaacacatttattttaaaaaacctaccttagttaaattatctgattaaatgaaatgaaagcataaattaacatacttcagcacaacttaaaaaaaagataaagatattcggtaaggtatatacatacataaagttacaaatacaataaatttggcttcagccaaagctacagccgaaggtaaacttatagtcttaaatgtcctttttccttaggaaaggaaagaaaatgaattacaaattcaacttcatattaaaaataaaaaggcaagtagaggaactgagtgaagataagagtgtaaatatacaaatcagtcaaatagcagagtttttcctttccaatgataagtcattcagcaagagaaggaatctgaactacctgaggaagcaggccagagttcatcacaatccttcagccctcagaccccacttcccaggtagccacagctgagcacagttacccagcagctctttttccccccaggagagaaagcccctcccctcaacccccaccactcaggcagatgcctaataggacttgctgaagaccacaaaagaacctggtaatactgcttgcagttctaggtgccaaacctcactggcgaggacagggtgcaggtacagaatctccctgcgtctgctccacctcctcccccagctggggacctggggttctggccacatcaccctcctttcccaggccctccacctcctcactagaaaaagcagttccaagaagagcaatgacaatgctgtgccttccactcccgcacacgggccatcatgccctctccagctccaggaaaaacccgctccaggcccatgcagcacctgagggtcatctccatccctcaacctcgcaacaccagcagcccaggaagactaagcttaaaagctaaaccgcaccttggattccaagggctatctccactaccccactgcccccaacccggctctgaacgcctcaccctgaaggggcagaagccaagtgaggtaggaagttagttaatgagctcatcggcattttttgtaatagctcaaaattttgaaggacccaaatgttcaccaacaggtgattcaatacacaaattgtggtatctccagcactcagtaataaaaaagaatcactactgatctgtgcagcaatatggatgaatttcaaaataattacactgagttaaagaagccagaccaaaaacgagtatatagtatatgaagcttttattaaaaattctaggaagtgaatactaatctatagtgaaaaagcagactaggaagacagagtttgggtttgaacagccacaaagcaagccaagaggcaccaggaaacttttgagggtgatgactatgttcattatcttgaagagtgtacagtttattatatgtcagttatatgtcaataaagctgtttttaaaaagctgatggtgatgatgtacagatttgaataggtatccgatttgtctggtctccatataaaacatagagaggatttaaaaaaataaataaataaacaacttactttgcatttccagccattggttggtactgatttcataactggttgaagacaaaaagtatgataccctttgtcacacgtatcacacactagcatcttgctatcttctcccgattgtctaaaaaataagatagcattaatgatgccttatctttaaacttatgttttgtaacataagtaatcatgaaaataatcagtcctgggaactgcacagttcataaatacctcagtatctgttttgtctctgcagatagtaacagaggtaaccctgccataaggattacctcctaaatggtgatctttactcaatgctcacctatggttaacttgctctagccattttaggattcctgcaaaggaggaagggttaaggcaagatgaatagcctctgatctttacttttaaaatagaatttttgagaggaaggtgctataactgataggtgctactgtgtggaaaggaacaaatcttggcacagcgaattgaaaagacactgtcgtataacgtaaagaggatcaaatttggcatcagatctctatttgtattcaggctgctgttttctagctgtgtcactaaacaacttagactaaagctctctgagttccaggtataaaatgggaataataaagattactgcgagaattaaaggtaatgcgggttcaagtgcttagaatgtctattaagcaattaaatgctgaataattatttcaaaatacgaaccttgtcataattattaagaattatagttgaaaacctaaaatctttctctaaacactcttctgcccccaaagattgggcccctgtcctacagctttatctctgttgagatttttgactataatcactttcagatactatgattttaaattcaagaggaggggaaaagaaacaacagggaaagcaagaagagctgagagaggaatctctgaatgaaatctgggggataaatagatgtcaacaggaagatgggtcagttagcctccaattattattcagttcagcctctccataaaaagtcacgttttatctcctcagctacgtggaaagatcttggaggacaagtactcttccttcaagttcttttaatccttcccaagaaactgagcgcagatataaggtatcgaataaatgtttactgaatattttatctaatttttaccaaaatatggaggtacatagtcctatttatgtcacgtaactctaagatactgacgtttatttcttatcaaactaaataataaaaacagactgatcatggcagttgggcataattcttgctggttacaacaaaaattctcagcctgtaaatgaagatactggtaacatccccaaattatcatgctcattagaatcatgggggtgcaagcggaaatcacagaaaagactggagaaatgaccaagagatgaaataccataggaaaatataacccccttacaaatttgtaaatgccacatatttcgttttggaattatgctgaccaggatctactcaaggtggcttttagagagatgcagatgtacattaaaataatagtagaaattgtccttcctggaatggaaattcaaacacatgactgattttttggctcaactctaattcttctacttctgtagttagacgtttaaatcctattaaatctcctccccagtaccccttaagaaaaactactttattcttctgtttgttttaaattgttaatatcgcttattttttaaattgttggcaaatttaaattagctctttagacgaccagagcaatttaaatgattaaaatcagttttgtttagacttctttcaaaattatataaatgttatttatattataatataataacaaattatattatggatatatactggataaatgttataatatccagtaatttttttaagtatgatgaagtcactgaatgaatatagctaaaatatgaacaacctctattatattacacaaacctttagcacctagtaatagggtccctcttaaacccaatacacagctttgaattgaaatgaaaacttacttgcagttctggcacactttgcactcaggacattgccaacctgcacgttttaatggagtaaccgctatatccaggcacattccatgatagtgctgaccacaagtagtacaaaagaactgatctaagaggtctcccgggctgtcgcacactgcacagtttgcatcttccttcgctataattaacagtgaaacaatgaaattgttgtataagaatttaaattttttctgactatacagtaaaatcatttgaaaggatttgcatcatgaacctttcagacatttgaagttattcacattgaattgtcatctaatcagaaagaggtaccaataaaaacactgtagggtatttaatctaaatgtaaccacattaaatttaatcgtatagttttgcaattatttgtggctatatctacttgagaccataagcaggtcttctttaattttctattcctaatgccaatgataatgctggatacctaattaatgctcaatatatgcttactggaaagaaccaaacaaggaaaatacaaattaagaaatgctttgcagtgtaacataaacattttctttgaatgttaaatatattttgaaattacaaaatcagataagagacaaaattaagaaacattaatatcaattagactaagatgcttcttaagcataaacagactattcaaatcatataagggcttttttttaattactggaaaatgccttatgtggaagaacattaaagacagaagctacatattcatacacaaacacattacttaatatactaattatatattcatctatattaatttctagttgtaaaagcattaaaatccacataattatggacatcatccatccctaaatgtggattaaaagaaaatgtactaacagttcttttaccatataaaacagaaaatataaggataaactgccctgccaaatatacagttaaacttatgcatactgcaaaataaggaaaataatgtattctaaaatcataccaatcttagataatgtataaaaaatatgcctgtatataacaagtatcacaaagtatatgaatcttttcattttttgaaggtttgatcattcctatctactattctgactcatacgttctttcttttccagtcaagcctatcataccaaccttagataatatatataaatatgcctgtatttaacaagtatcacaaagtatatgaaccttttttttttcctttttttttgagacagagtttcactctgtcacctaggctagagtgcaatggcacgatctcggcttactgtaacctccgcctcccaggttcaagggattctcatgcctcagcctccccagtagctgggcttacaggcgtgtgccaccatgcccatctaatttttatattttcagtagagacggtgtttcgccacattgcccaggctggtctcaaactcctgagctcaagcaatcctcctgcctcaacctcccaaagtgctgggattacaggtgtgagctaccacactcagccttttttccattttgaaggtttggtcaatcctatcaatttctctctgactcacacgttctttcttttccagtcaagcatcttgaaacagagtaaaaatatatttcttttatttgtaccggagtctgcaaacttttcctgaaaagggccagatagtaaatattttaggctttgtgagccatagcagtctctgacaaaaagtcagactttttgtttttatttgcactcttttaaaaatgtaaaaataattcctcgcttgagggcagtacaaaaacaggcttcaaaatgtggacgctggctggacctctgacgtacttcatgaaggctggcttagcacctaatactcatctgaagctacattagtgaggttgccaatgcccataggaaacccgattgttactttttagtctttggctttttgcactttgtagcatttgcattgctagccactcccacattaaaacgcccctttccttagtttctatcatggcaactctctcctaatttctccttagttttcccttactttcatctcatcctcctttgttggcttttgtacctatacaatctttctaaatgctggagtttcttaggatttcatccttttccttctttcctaatcccccatagtttccctttgtgatcacatcaactctcatgccataaaatgccaccatgattcctaaatctgtattattggccctagaattctttcataaaccccaaacctttattcttcaagtcttactggatctcaatagccagatgttctaaaaacactcaatctcaactgctctaaagtgaaacttttttaaaaacccgaaacatcatccatttttctcaagaatagataaaggcagaaaccttagtatcactgttcactctgaactcagccctgacccaacacatccagccagatcccaattcttatgtattaaacttcctacacatcattcttccttgtatgtttatagtttagtctatcatattaggttggtgcaaaagtaactgcagtttttgacattacttttaatggcgaagactgcaattacctttgtacctacctaatactctgtctcgctaactgcagtatcttctgcatcaaatcatctctacttatggttctgacatcctgtctaaatcattttctgcacatccagaacaatctttcaaaaatgtaaatctaattgttaacctctgtataaattaaaactccaccaatacctcatttttcacctaaaagaaaatcagaattttcaagtatgaggcaaaaaggcccttatctccctttccaactgaatctcagaaccactcactatctcgtggtcatggtgggttgtctgccatgcacctcacataacatgctattcatgtctgtgtgcttttacacattctgttccctctgcttgaaattttgtttttctgctgtgctcccagccttcaaaactctgctcatggctgggcacagacactcacgcctgtaatcccagcactctgggaggccaaagcagatggatcacttgaggtcaggagctcgagaccagccgggccaacatggtgaaaccccatctctactaaaaatacaaaattagcagggtgtggtggcacatgcctgtagtcccagctactcaggaggctgaggcaggagaatcgcttgaactcgggaggtggaggctgctgtgactggagtttgcgccactgcactccagcctgggggacagagtgagaccctgtctcaaaaaaaaactctgcacattatttcctgaatacctattaccacacccaaatacctttagttgttgaatattacttttacccatatgcttacaagaaacttctgttacataatcaattaattacagcacaactctgtgaatccttgaaggacaggggccttaacttttttaactttgtatccccaactgcctaacatgaatcaagtcttattgaacatattttaagtgaaggacttactgctaaaatcacttttaaatggctctttaagtgataggcatttaaaataaatcattaatctaacaatggaagcatcataaattagttcatttttgatagaaaggacataactgggatgttatgtttcttaagacagtaccagtatttatctttcaaaatatgtacatttaaaaattgatctttttgctcaccgtaaaacttttaaaaattgggggaaataataaactaattatcagataaacaattcatttttctattatactttcctaggaacactaaaatgcttctgtgaaactttctagagtttgctcccctgacacttcaagttgccatggtagctactagcgacatgtggtttccaaacaagtgaaatgtaattagttcaaatcgaggtgtgcagtaagcataaaatgcacactggattccaaaatcttaacaggagaaaaagtatctcaaaatttgagatattactattttggattactgaattaaataaaatttactacaattattcccaatgtttccttttactcaaatttttaacatacccactagaaaaattacttatgttgctcacattgtatttatactgcacagcactgttatacacaacaaagttcgctctgcaacaagacaactgtcattgtcacaaaaatcactttttagactatgatgatttccaccaattccttactgataaccttgctgtgttctttgattactatggatcattggtaataaattagtcaaagaaaaacatccatgtaatacatacatctggtgcaaaaacacttaatatgccttatgtgaaacacaataatttttaaaagcactacacaaagaaatgaggttggttccaaccctcccagtcagggagaagatgtgtgggaatactgaaacaaccttttggaggtcatgtacaagattatcgatactactggatagctttggtgtcatgacagaaattaaatatgaatatttagacacacatgtctgtaagccagagacactaagtttaaagcaataatcaactaagaaatttttctttaaacagttgaaaaagcaaagacaggctataactaaagataatttaaaagggcagaggagtaaattccaggtctatttggattctaagatcaggctcttgactactaatcaaattgactcctcagcaaactttactactgatcaatgaaagtgatgagtatttgagtatacacaaaagtagacatgaaatgccaacagtggcataagatgaagctaaatgaagtaaagggagcaaggttcttatggcaggagaaaagtgagaggaaacaaaatgatcatctttagagaaggtcatttcctaaaagacagccgtaaaaagagaagagataaataaaaaagacaaaaacattgagcttaaattagaacagagcttatcacagatccttaaacctgatgaaactattacttaagaaaatccagacaacacataagaataaaagcattggtgaacagcaacaaaagtcaaaatagctgtcatacagtgtgaatttaagaaggaccaaatcagcattgctttctaatttccatcacaccctatcatctgccaattttcatcactggcaggacactgtgctgagtgatttgtctataaaagagaatctctgggaagaaaaaataaatcatggatgtcatccaaagaggctagaccgtatcattggcaggtagataagaaaggtcagaggactgacagaatttagggtaaaagaaaagcaacaggacttaatgtcaagaaatacaaagataaccaaagaaaagaggctggagttaaagcttaagtgaagtaaaaggaattaaagctaaatgatgagtaaatacattgaggaacagggggtgaattaggatatgtagcatttccatgtttaaaccttgcaaagacttctcattgcagaccgaatagaacccaaactccttcccttgcttacaaggcctacatgatctagcctttgttcgccttgatgatgtctctactacccacctagtaggctactatgctccaagtaaaatgacatgctgcctgttcatgaatcatgccaaatccattcctcaaggtctgtgtagtggtctgttccctctccctggaatgttctttcctcttatcttgcatgattggctttgtgccattcagttttcctattcaggaagtatatctggttgtatctactagatggatttttagggtaaaatttccagacaaggttaatgtatccttgtatcatcatgaaaataatgttgcaacaatgaccagccatttacctatgacagagcaccctaaaagtgtttcctgaagaaaatcttggccttcttcacagatactctctttagtgaatttctttataatgagatgcatgcttttgttaaatttctcaacttttataaaaagatgtcaaccttactcctaactcagtcaactatcacagctactgctctgccccttaggaagcaacagaaaatacatatactcaatatgtattatcattctcataacttaatccttagataggaggtaaaataactaccctttttaaagcaattaatacatacaaggcacaatgttatgtgaattccattcattgttttcatttaaccctcataataacactatgatttaagacagtatcattttaaaagcataaaaattaacttctgccatgacacacaattaggataggaaaaaatatttataaaacatgttaaaaaggtgacaaaacatcctatctgcaatattctttaaattatatccttggtacttaatccaagattatgatcgtcttaacagatgggtcagaacgctgtgtagttagaatgcactgcttaagatccccaaggaggccgggcacgatggctcacacctctgtatcccagcactttgggaggctgagacgggcagatcacgaggtcaggagttcgagacgaatctagccaacacagtgaaaccctgtctctactaaaaatacaaaaaattagccgggtgtgatggtatgcgcctgtaatcccagctacttgggaggctgaggcaggagaaatcgcatgaacctggaaggcggagtttgcagtgagccaaggccatgccactgcattccagccagagtgacagtgcgagactccatctcaaaaaaaaaaaaaaaaaaaaaaccccaaagaaatctaatttagtcatttaggccttgattttacaccaccgacttagtttgaaggctgctataagaaacagccctatgaaactgatatttttctactgcaaggtggctactttaagataatttttcattgcattgtatcaagtgatgtcttgttattattatatcattatatcaagtgacgtcttgttataaatagtaagaatcagattaagggctcatatttccttctttgtattgactgctgaaaaggtatggggccaaatttgtggttacgtctggagttatatatttttggggggggtctctctattaccttcatatttatcctatctaaattttccattgccaaatttccttactttagttttatcctattgctcatgtatttttatgagtctccataagtctattttggaaaaaggcagagtactcataattttagtgtatcttttagctttatgttgccataaacctttcattatatacatgatcaacaacagcatattatctcacctcagtatttattattttacaaactgatttatgattgctaacatgtaactgaaggtatacactgttagaacacagttttcagtagaaagtagcactgccattaagtaataaaatattctaacactacaacaacattcttgtaaaagtttgcatgttgtttgctgaggtctaaagcatgattaactacaaaaggctgaataaaattcagattcctatatacacacaaaattgttttattgagatgacaaagtatatttattatgccacccagaatataatccactctgataactgccagtttatgcacttgctgaagtaactcagtacataaatagtagccgtaacagttgcagtgcatgaagttcttctcttccagattgaagagtgtacaatctaacgcattttaaaactttaaatcccttattagcctaaatataatttaaaattctagtttgccttacctataatttgtacactaggttactaatggtgatatgattacatatgtggacacaaaataattttaatggaaaatgaaattatggtactcaacaaagaaaagggtaatgatcatgtagactaactgtatttgagattagtttaagcctggggtagctatacttacgtttcacagacctggagaagataggaaaaaagcttttattaacattgctaaggaacagataaaagctaacattaggtaactaagaggtgacataaaaaagattgaataaaatatcatggaggtttcataatgagattggaaattcaatagactaggagaaaaaagatcccaaaacatatatgctcatagggaaaacacatagtaagaaaaaggagagatctctatttaatgatacaatagtaaagagttataatttcctgtataatgtaaatttcacgcatttaaacattttcattgaattataaaatactatttggaaaagaaaaacagcacaactgcagattacagaagactaagatagatgaatcatgaaaaggtactagcagagatttctattatacctatcagggaaacacaatttctaagaatttcagaagtctttggtgttcttattaacgtaaatcctgaaataacacctgagtgaactgtcttctaattcttcaactggatggctttttagtgttgattgactttttaataaattattttatagtataaatcagaaatactgcatagtccctatttacatctttctacagtggtttttaaaatgttttaagaataaaaaccatgcaaactttatttgatttttctgaggaaataactttttggatttaatttcaatgaaaccactgataacatttccctccccagcgatccctggcaacgatccctcagattttaaagattatgtattattaccttttaatacaagtagaataacactcagggaatttacaacatttgttattttcagtaaatacattggttgaagtttaaaagtctatccgtagtaaacttacatctttcaggagcttggtcaatgtgttctggacaaagcaggaagatgtgactgaaatcctgaaaggtgccggctcctgcagcacaaggataatgatacatctgggtacatttctcttcacagcatttgatagtggctccaaggtgcttacaaaatgcacatcgctgaaaggggtaaaggagagaaatctctttataaaaccttgaaaaggaatattcaaatataagctgggaaggtataaaaaactctctgtatatcacaagtaaaacaaattgaacctgcaaaatattaaacaaaggattcgttaaaaataataaaatctacattactcaatttagcgcttcgtgtgctaccaactcatccttccattcaaattagaaagttagaatttcattccttatattttcaaaaataaattttgaagcatttttgaaacaaaacctaaagatttttttttaaagcaaatagtaatatggttaaaagggcaggtttctatattgaggattattataaagtttttaaatcccaccaaaactagtaataggaacatatattttatttatgagacatattactattttttaccctgcctaaaaataaatacaaaataaactcatcaattgtaagttaacagggacacaaatggttaaagactcacagaaaaaaacacaaaactacatacttcaatgtagcaatcaacttcaaatttcttaacaaaagatggaaatgtgggcgaaaaaaaattagtcatctggtatctttcccatttcaacctgcctccattatcttgcaagtggtaaaacgcacagaaataagccccaaacaagaggggcagtctagggcaagtgaacacataagaagtcagaagaaattatgtaaaatgttgcatttacttattcagttttcccttagaatgattcacaaactcttcctcattctcccaagtccactttgagcatcattttctttgaagagagtttgatgggccctgtactatacagtatgacatctctctgtgggaaatgactatctaacataaatttttgtttacaccattacatggtacttacttgcttatgccattacatgatcagtttatcttttcctcatcctagtccaagatccttcaattgaggcaccatactatctttgtatccaaagcaccaaaaatgctgcttgaaacaggccctaatagaaaggtgttcctatacatataccaaaaagacttaacttttggtgatcttttttgtgagtgtggctcataaacagcttagctgagataactggagcctcatgtaacacagacagttggaccctgctaacattactgtggatatcttcacatgttactacactgactttatattctgctaattaaccagggactacagtagttaaaattataattgttttcaatgttttatgtgtaaatctgtatatcacatactatcaaactcttcctcactgtcatcagtctactgcactgaatcaacataacaaagctaagtgactcctgagggctgaatcagaaagaagaaaagaaagagatacaaaaatttggctgggccgggtggctcacacctgtaatcccggcactttggaaggccaaggcgggtggatcacgaggtcaggagatcgagaccatcctggctaacacagtgaaactccatctctactaaaaatacaaaaaattagccagacgtggtggcgggcgcctgtagtcccagctacttgggaggctgaagcaggagaagcttctaaataactcataaacagtaattactgttgtgacactttaattttatataatattataagtatacagaataacatttcagtgctattttggcactcaagggtattaatgcattagaaacacagaaaataaatatttttcttcattgataaagtgtaataaccagcttttacaaaacaggtaattttttataactcccaaggtatctaaatatgtttagtgcattaacagaacccagaattaactacaaatacaacacctcggtagtctaaatgtctgaatagaaagaccacgtaaatgtcgaaaggaaaagtacaatcaatctgttgaaaaatgtttataacaactcattaacataactaatttctgctaaattgttaaaatctaaaatcgcttattttgataccatatggcaagttttgcagaagccttttacactaaaaataatcttggcagataaaatataatgagaggtaagtatataataacagaaagtaatttaaattgaccagcttctcaatgtctttctcattttagaaacaccaatatgttctcttaatcatatctgcaatgaaaaatattatattagctaaactactatgagaagtactggaatatatctaacatactaatttacaatatcatataaagatatcagtgaataaaagaaggaaaataaaacactacatttaggagaacgcttcaaacccatctgttacaattaaatagctaatgaagagcactcggcattaaaagaaaatgtttactatatatacacagtctggaatgtatcttcctaaaccaagtaaaaagtacttgtaaaatcgtagacaatatcaaagaatggatttccacagggaacttctcaaatgtcaacactcttatacactacacataaaagaaatcaagcaagttaaaatattaataatacaataagtaatatataatacataagtaacaattacgaagctaattaacatttggggaggagggataaagtaaacagctcttggccgggcatggtggctcatgcttttaatcccagcactttgggaggctgaggcaggtggatcatttgagctcaggagttagaaaccagcctgggcaacatggtgaaactccatctctacaaaaaatacaataattaggtgggcatggtggcatgcacctatagtcccagctactcacgagcctggggtgggaaaactgcttgagcccaggaggttgaggctgcagtgagctgtgatcacgctactgcactctagcctgggaaacaaaagtgagaaccagtctataaaattcaaaaaaaaaaaggcccttaaatggtgtatcaactaaatggtttatttgaatcaataatgaaaattcctagacagcattttttctttttacttttattcatcattaaaaagacagggagtaagaaaaggaaaaaagtaacatgttataataatattttcccatattaatccaagaacacaataacaacaacaacaaaaactcagtgagaactcgtattaccaattttaagaatgagtctgaggaattttcaagacttttatttaatagtttgaaataatctgtcaaaatgtatccataaaacaaaacagaatgaacaaaatttgagattaaagttgtatcataaaaaaataccaagaagttaaatattccacagttcatttaattaattatccagtatttattctgtaccaactatagcaatggttttaggctacgtgctctaataaataagtattataaggctccccatgctccaaatttgtttttaatcttcaccagtctttttttagtattaggcaactaggattctcccaggatgcagtaataaagaacaaagatggaaagtaagagaaagaggtagaatgacatgaaaatctgatccagaaggtgcaatgtctgttttatatgagtaccagaatgggagaaaatgggagggattataatcaccaaaattctaaaggaaaagttatgtaaatatctaataataaaagctaacatttaattaagcataatcctcattcaacagatgaggaacctaaaaccgaaagagtcattatcactgttccacttatttctatatccttacaaaaatacccactcttgatctgtaacaatgtctccttaaactccctgaatggcagcttcaggtaaaaacttcccagaaactttgaaataacaaggataaaaggaaaattcttggagccacataaaaaagaaaacagatcattacaaaaaaagaagaatcgggcatcagttctcattatcaatactgaattaaaaagaaacccaaaaaaaatcattatttttctaggcctataaaaaattatttaaaaccaaaattttaatgtctgttaagctaacattcaagtccatggataacaaatgtaaataggttaaattctctagtaaaagatagcaactttcaaaacatgcaaaatatactacataacacatatacatattttacatattactacagacttcatttatgtatgtgtgtgtgtgtacacatatataatatgaaataaatgaaatactttggatatttgtccccgccaaaatttcatgttgaaatgtaatccccaatgttggaggtggggccttatgggaggtgtttgggtcatgggggcaaatccctcatggcttggtgctgtccttgcgataacgagtgagttctcacaagatctggctgttcaaaagtgtatggcatctccacccctctcctttgctcctgttctggctatgtgagatgcctgctcccccttctccttcaaccatgatttcaaactttttttttttaatttatatttatttttttgagacagagtttcactctgttgcccaggctggagtgcagtggcctgatctcggctcactgcaacctctgccccgcaggttcaagcgattctcctgcctcagtctcccaagtagctgggattacaggcacctgccaccgcgcctggctaaatgatttcaaacttcttgaagccctcaccagaagcagatgccagcaccacacttcctgtactgtctgcagaatcgtgagccaattaaacctctttttgttatcaattacccagcaacaggtatttctttacagcaacacaggagcagctatatatatgcacaatgcacagtgacatacacaattcaaaaacagacttgaggggaaaaaacacaaacgctaaccaaaaaatgcaggtatagcaataattgcaaagaaatagaatttaaactaaaaagcagtgaacaagtcaaagataatatttcataataacctaagttttatgttacagtgtaaattccaaaagaagccatagtcattaaagtttatacacctaataaatatatgtcacatataaaaagtaaagctgagtagaaataacatgcatagattagactttaacatagctctcaaatcaggatattaagtagatatgaaataaataataacaatgatcgggtttgattcaaacagacacataaaatacacacagatctctgtattccaaaaatagagaaaacattctattcaaatatacatagaattttcaaaaaaaaatccacatgtatggtcgtaaagaaatgtccacatattttaaaaagcaggtatttcctaggttatattcagtaaaagcagatgtgtccctagacctaatacaataaaaattagaaattcacaatataaggataaagtcccaaatctatccactggcaaaatttaaaagtcctttctatataacggcagagtttcaatcaagaagaaaaatcatgtattatttttaaatgattaagaaacatcaaaaaaatctctgagacgtggcaaatgtggtcttcagaggaaaacatatagcttcaaacatgcaaaactataagactaaagaattaaaataaataatgcccaattcaaaaattaagccaataagaatcaacatataatccatgagattcacaatctagggaagtaaacccaccctaatactgtgtttattaaaatgctgttaatgagatccgaggtttaaacaactgttcactttagaaaatgaaataaagctgactgaaataaaacctaatctatgaaattattctgtatatgaattgacctgaagtaatgaacagttcattgactgactcataactcttgttctggtccaggctaatcattctagttggcatactattaaacacacatttctgattgaaacatctgctaaaaaaaataacatcaaacgacattacaaaatcaaaatggagactgctaagagtgggatttttctcctgccagtacctttcctttctgccacattctcctccctgctgccacagtaatctttctgaaggaatacaaatatattctgaatcacacgcaaacccctcaatacagaatgtgtggtaggcagtattctaaaatgcccgcataccaccgaccccaccaaatttcctaccctaatacagaggctgtaaatatgatgaaatatcatggcaaggataatgccattaatatattatatggcaaaggaattctgcagatgtgattaaagccaccaatcaactgcctttgaattaatcaaaagggagatttgcctaatctaatcaaataacctctttgaaagcggagttttctccagctagtagcaaaagggaaattcatagcaagggaacatttcaatacactgttgctatctttgaagataaaaagagccacgaggaaaaaccaaagagtggcctctaggaactgagagtgacccaagccaataggcagtaagaaaatggtgagctcagcagggtgcggtggctcatgcctgtaatcccagcactttggaaggccaaggcaggcggatcacgaggtcatgagatcaagaccatcctggctaacacggtaaaaccccgtctctactaaaaataaaaataaaaaaaaaaaattagccggcgtggtggcgcacgcctgtaatcccggccacctgggaggctgaggcacgagaatcacttgaacccgggaggcagaggttgcagtgagccgagactgcaccactgcactccagcctgggcggcagatcaagaaagaaagaaagaaaatggcgagctcagccctacaactgcatagaactgaattcctcccacacctgaatgcacctagaagaggattcacccccagagcttccacccaggtaacaccttgatttgaatcttgtgagaccttaaacagagagcacaggtgagcctaccctgagttctgacctaagtaaatggatgctgttttaagatattaagtttatggtaattgctttattgtaacagataacaaacagagcagcatttcaaggccctccatgctttggtctctgccaaatcactattacatttttaagatttttttttaaacattatacttacattacacaatgtcttaacactatgaagtaaaaatgtaaatattttaaactctggcttggaaatgaggaggcagaatctcagatattttcctaaaaaaataggagaggcaagctttctgagtccacaaaagtgccctctacctattgggtcaaagaaaaagtaatctctctatttgtaacaacatacataaattataaaccctgaagaaataggtccctaatagctataatctttaacataaccataaataaaaacatgaataaatctgactacatagaaatgtaaaaacttctatgtggtgagaacacacattacagaaaaaaaatcaagtgacaaaaaataacctccaatttgaattacaaatatctagtatcctggatatatacaaataaagcatgtaagttataaaaatgagtataattttaaaatagacaaggatagtttatagaatttcataatttaaggaagacataagttagccaataaactatgggtaatatgcaagaatcagtaagcattattatttgccagcagctaagccaagtactttataagaattactttattcccatctacgccaggcacagtggctcacgcatgtaatcccaacactttggaaggcagaggtaggtggatcacctgaggtcaggagtttgagaccatcctggccaacatggtgagaccccgtttctattaaaaatacaaaaattagctgggcctggtggcaggcgcctgtaatcccagctacttggaaggctgaggcaggagaatcagttgaacccaggaggtagaggttgcagtgagccaagatcgcgccactgcactccagcctgggcaacagagtgagactccatctcaaaaacaaaaacaaaaaaaaaaagaaattactttattcccatctaaccaccaccatttcaggtagatattactatttttcattttacaaatgaagcagagaggttaaatatccttgttcaagcccaatgagtcaggaaatgaaaggaactgaactcaaggagttcataattagttatatacaagtaataaagacaaattcatcgactatggaaatgtactaagtactttgtcttgtttacgtaatggtttttatttaggttgtaagaaaataacatatggacaggcacggtggctcgtgcatgtaatcccagcactttgggaggccaaggcaggcggatcacttgagaccaggagttcgagaccaacctggccaacatggtgaaaccccatttctaccaaaaaaaaaatacaaaaattagccaggcgtggtggtgcacgcctgtaatcctagctactcgagagactgaggcaggagaatcgcttgaacccaagaggtggaggctgcagtgagccaagattgcgccactgcactccagcctgggtgacagagctggaccttgtctcaaaaaaaaaaaaaagaaagaaagaaaagaaagtagccactttggggttagaatccataaaatactctcagtgtcaaccaaaagaaatgtactgcaatgttcatagaacacaattcataatgacctcaaattgaaagtcctcaaaatgcccaacggtaaaataaataaattatagtactcttaacaacagaatactatacatcaatgagaaaaataaacgactggaaggaacaatttggatttatctcacaaatatatacatgaaagatgacagaaaacagtacttagtagccaattatacaaagtacaaagccaattacacaaagtacaaacataggcaagactcacctatgttgttactagatgatagtgcatgtctttggggagttaggaatagtaaccaacaggaggctgaatggaatttctggggcgctattatttgtttcctgatgtgattttagtatatacgttctaatatttggggtattcctagaaatgtgtacctattattcacttgctatatatatagcaaagtgaattttatatataattcttcaacatatttttagaaaaattaagttttttctagaaaattaagagaattttagataaaaactcaacttttaatggaaaatattttcctttttctttctcacatgaaattctatatcaaggttagtatcctacctggtatctctccaatagtgggttaagagtttgttttcttctcaagtaacctgtattatattaagatgatattaactgaaataatcagatagatgaatgcgccataaagctaattctaagatatctgtccttagccaaaagcagaaaagggatacacataacttccacataaaacatccacccccatttttttggttattcttaaaagctcataatgtatacaatgataaaatttattgtttcaaattagggtttttgaaattgaaatattaatttaaacacgtttgcttaacacaactttaaagttaataagaaaacactgcctattacagaagagttaaatacttcaaaaagtgggaaaaaatttaaaagctttcattttagtaggagtaaacacagacacagtaagaatcaagttagttggatacacttaaatcatgtcttttaagaacatgagaacagattatttgctttctctttagtccaaaacctgggtgtaattttagtccaaatttgaaactaacagaagaatactcagcttcttaaaagttttatttcaagaacagtaaaagaacttctggtcttacaaacattacacagataaaacgagtttctccaaacagatgtatgtaaaaatctagtacatatacccccaaggtgagtcaataaggtgaaccagattctggttgaatggaatccttgaaacataactttggtgaacaaactgtttgtgttttccacttttcttaaaaaagaagtgataaagcagatttccagtacctgccaactgataaaatgctacttaccaggtaaaaaccactaccaaaaatcagaatcacagaagggctatcagtaaaattactaatgccacaaattaacatgatgttaactgctgaattatgcatcaaaagagtatttatataatcacagcaaataactcaaatcttttacatcactagtaaactcaaaaaaagatagaaaaaagcaataacattaaatttccttattgatctactagctttaactatttaatactagtacacttagttttgattactttgaaattgaaacaaaaacaataatcttttcttcttttaatgactttttcagttataggaaagatgatattaaaagaaaatatacaactatagcttagctacaggtataaaactgttttaaagatatgtaattgtgctattgaattaaactgaaaacataaatatcaactcatgattttgaaaaaaaatctttatgtttggttttggtaaaaggagagacaaataagtcagaaaaacagaaaatacagaaatagactcacttttccatattcaattaatttttgaccaaggggccaagataatccaagagagcaataaatagtcttttagaatgatgctggaactgctaaataatccgtatggaaaacaaagaaacatgaatcttatctcaaattcttttatcatatgtgtaatttaaccataaatggattttttaaacctacaactaacactggggcaagcaaagattttttaataaagcataaacagcataattttttcaacttccaaaaaattaacaaatgaccaatgtcatcaaaattaaaccctctgctgttcaataaacattgctaaataaatgaaaacaagtcacacattaggcaaaaatatttataaaatgcatctccaaaactgacttctgtgaataatatataaaaaaactcttacaactcaagaagatgacaagtaaatcaattggaaaaaaatggtagagacaaaataacagacatgtcaccaaagatacacaaatggcaaaaaaagacataaaaagaggctcaatctaattaatcatcagggaatgcaaaatcaaacccacaataaattatcactaaatgccaaccagatggctaaaatttagaaacagtggcaatatccagtgctggcaacaatgtacagcaaatggaactctcagatctctagaaacggagaagtatacagacacttaagaaactgtgaaactgttttccaaagttaagaatatatttccaacaagtcagaaattccagtcctaggtatttacccaagaaacatgaaaagatacatccacaacgaagcatgttacataaatgctcacagcagctttatatactggccaaaaattgaacgaaacttaactgtaagctagtgaatggaccaatctcaaaaccattatgctaagtaaaaaaaggcagacagaaaagattctatactgtatggttccattcatatattagtctagaaaaggcaaaactataggaaagcaacagatcggtgattggcaggagctggagtgggaggtaggcagtaacttcaaaaggtcatgagtgaatttatgggtaaagggtctattctgtatcttgactatgatggtaattacatgactgttcatatttaccaaatcacattcaatacacaccttagaaagggtgaattatagcgtatgcaaaatataccttaacaaaacaatggctctcacacataaatttatttatttattgggtaacagcatagggactaatatcagagtaactttcctaaaatgtctcaaatctgaagaaaacgtaaaagctaactaattgaagttacctgtaaataaccaaaaactggctggaatgggaggacattatacccttggaaaaaaagcagaatatcattggctaaaatctatatttaaatagagtttcagtctgggcgcgatggctcctgcctgtaatcccagcactctggaaggccaaggaaggtggaccacctaaggccaggattttgagagcagcctagccaacatggcgaaaccccatctctactaaaaatacaaaaattagctgggtgtggtggtgggcacctataatcccagctacttgagaggctgaggcacaagaatcgcttgaacctgggaggtggaggtggctgtaagccgagatcgcgccattgcactccagcctgggagacaaagaccctgtctcaaaagaaaagaaaagaaaattctacaactaataagtatggtaatttcaatgaaaattttagtggatgggcttaacaagagattggtagaaaattggtccatctccttgaaaatacatgaatagtgtatctattctgaggaactaaaagtaaaaacactgggaagaaaacgaacagaccctcagtaatctacaaaatatcaaatatactaacattcatgtaattagagttacagaggaagaggagagagaaatgagacagaaaaagaataagaaataaaagtcaagcttttcacaaatttggtgaaaaatatcaacttacagtttcaagaagctcagcaacccccaagcaggatgaatacaaagaaaaccacacctaggcacatcatagtcagactgctgaaaaccaaagataaagagaaaatcctgaaagcagccagagaatatcaaaacattattatatacatgggaataatgatactactgacaccacacctgacttctcattagaaaccatggaagacaggaaacaatgcaacatcttttaaatgcttgaagaagaaaaacataatcatcccagaactctgtattcagggaaaaacagcaaaaatgaatgcagacttccacttccagacaaaatgcagaaaatgtacttttccctgttctttccactaaatacagctttaaaaacccttagccgtgatacataagacaaacaaaagaagacaacaaaatgtagagagagggcagaccaattagggcttcaggagccaagaaacaaaagaggatgaattccctaggtttcctttctgactcatatatacaagaaaagttgctagagaagcagacaactcagaaacaccaacaggcacacacatacgtaaaactccaagaaaattctgctgtcttttgtcaaaaaagcagggaagcggcaggctaccaagacaaaaaactcatagacaacaacaaaccagtttaagccaaatggtacaaataaaagcccaagccatataccttttgcaaagacttaaaaggaggacatagtcagccattccccactcctgcccacggacaacatgataccacagcaggccaactgggacacaggacattcatacccactgagcagtaacgcggcttcctccctctagagtgtgggtggaaaaaaagtggggagcctgagttcaacacccacccagtgataaggacatatccctatccctccctctacagagatatgacaggagaggcctattggagaatccaaactcaaagcactgcccagtgataacttaaccacccctccatcccattcagtggaggccaagtgaaaagcaggaaccttttgagccagggtggtattcacaaaggtgtaatgcaagtccagagttttcactcctactcagcatttactaggtgtacgtctccatcaatgagtcaacaaaggcctactaaggaactggaatcttcacatacacctgggagtagtaacaaggctgtgccccacctccaccccaaaagcaaagtttcagataaatcctactaaaagggggtatttaaataaaatgcagagcttcataacacaacacttaaaatgcaaaggattcaaccaaatataacatgttataccatactaagaaccaggaaaatctgaacaggaatttgaaaatatagtcaaaaggtgcaaacaatgagaattcatagatgtcataattatctatcaaagattttaaactatataacactgcttcaacaagcaattacagccggacacagtggctcacgcctgcaatcccagcactttgggaggcagaggtggttggatcacttgaggtcaggagttcgagaccagcctggccaacatcatgaaaccccatctctactaaaaatacaaaaattagccaggcatggtggtgcacgcctgtgattccagctactcaggaggctgaggcatgagaatcacttaaacccaggaagcagaggttgcagtgagctgagatcatttactgcattccaacctgggcaacagagcaagagtctgcctcaaaaaaaaaaaaaaaaaaaaaaagcaattacaaacatacttttgaaacaaaggaaacaatacaaagttttgcaaagaaatcaagaaagaaacaaataccaagttgaaaactaaaaaatatgctaacaaaaataaaatacaaactaagctgaacaacaaaatgggagagattacccaacctaaacaagagaagaaaatgaactgatttaaaaaaaaaaaaaaaaaaaagtggccaggtgcggtcgctcaggcctgtaatcctagcattttgggaggccgagatgggtggatcacctgaggtgaggagttcaagaccagcctggccaacatggcaaaaccctgtctctactaaaaatacaaaaattagctgggcatggtggcacacacctataattccagcgactcaggaggctgaggcaggagaatcacttagacccaggggcggagtttgcagtgagctgagatcgtaccacttcactccagcctgggcaaaagagcaaaactctgacaataaataaataaataaataaatattttttttttaaaaaagacattaaagacacttgtgggactataataagtgatgcaacattcctgtcactggaatctcagaaaaggaacatgacgcagctgaacaattattcgaagacccacagattcaagaaattgaataaatcctaagaggatacacacaaataaatcaatgctaatatatatcataaacttctgaaaactaatgactaaactaaaaaaccctgagataaataagagaaatgacaccttatccacagatgaaaaacaactcaaatgacagcagatttctcacctgaaaccatggaggccagaacaaagcagcataacatttttgcaagtcctaaaagaactgacaacaaagaattctatatccagcaaaaacatccattagtaatgaaagggaaatcaagaaattgtgagatgaatgagaactaaaaattagtcatgagacaaaactacaccaaaagaatagtgagaaaagttattgaaccagaaaggagaatgataaaaagaaggattctcagaacatcctgaaggaagaaagaacaaacaaatagtaaaaatatgggcaataaaacagactttactgttccttgagttttcaaaataatgtttaacaattgaagcaaaaattgttacacgatgcaaaagctatggtgggtaaaactgttgatgcatttccaaaactgaaagcagttggcaccaagctgtattagaagttgtcacattctcaattggcactacaactacagtaaaaataatgtagagtatcattgagaatatcactgatgaagcagcaaaaatcattaatgttttaagtcttgatccatgaatacacatcttttaattatctatgtgacaaaacgagaaataaagagtaaaataattgttacaccatagtttttcttgaggaaagaatttgtgatcatgtgatttataaactgaaataaatgcttttttcatggaacaccggttttacatgtaagaacaaataacaaaccacaattattaaaacttgattatctaacatatttcttgaaaaaaggaataaagtgagcctgtcacttcaaggaaaacaacttagaacatgagtggacaataagaagatttgaaaaacttatatccaacaatgtaagcttaactaattccaatacttaaagacttttctgatgagatcagtggattataacaaatgtgaattttgttatttattaaaaatgtgtaggactaggcaaggtggctcacacttgtaatcccagcactttgggatcactggaggccaggagttcaagaccagcctagccaacatagtgaaaccccatctctactaaaaatatgaaaattagctgggcctggcggtgcatgcctatagtcccagctactcaggaggctgaggcatgagcatcacttgaacccaggagacagaagtgagctgagatcgcaccactgcattccagcctgggcaacagagtgagattctgtctcaaaacaaacaaaacaaaacaaacaaacaaacaaacaaaaacaaccgtatcaatagttggaatatctggatcactcagtgaaccaatattttccaaagaccacttagtaatcttataaaatcatatatgggtaaaagatcccctgaaattgcaaggtagtctaataaattttatatatatatgtgtgtgtgtgtgtgtgtgtgtgtgtgtgtgtatgtgtatatatatatatatatatatatatatatatatatattttttttttttttttttttttttttttttgtctgagatggagtctcactctgtcacccacgctggagtgcagtggcacaatctcggctcactgcaacctccaccacctgggtttaagcgattctctgtctcggcctcccccgtagatgggactgcaggtgcctgctaccatgcccggctgatttttgtatttttagtagagacggggtttcacaatcttggccatgctggtcttgagctcctgacctcgtgatccacccgcttcagcctcccgaagtgctgggattacaggcgtaaaccactgcgcccggcccataaattataattttaaagggtaaagatataaagttcattgatgggattgcagtcttcagattgcaccaaaccacttgaaaaacttgcgaaactaccacttctcaagctttggtttagtatcaaacaagaatattcattagggcttgtgctttcattcttatagtatcttttaataaacagaagttatttctcaaatgtagttgaatgctccaatattttcctttacattcagtgctgtatctcaagaactcttttacaaaaatattatcctatattatctttttaaatataaataaaaataattatctttttaaaagcttatgagttcaggtagaaatatgaagggctaaaaggaattggaagacattttcctactatttgttctttctcttgattttcatgattcattattcttgtagaagtgaccttaccacagtataaggttcacttataatcactgttctgccttgtaattttaggtgaatttgttacaaaatattatgaaatctacaggaaaagccaactttcaaagctattaagtatttgacttaatagttgagggcattattattcagaaaaatttcaatctcattccgcagcgcaaaaaactgcaataaaactttaccactgccaagtcactaaattgctatgtagaatggcaattcagtatattctgcctctatatctaacaaaaattcataggatttgatgatgaagtccacaaatgcaagtcaaaatcactgctgacactattatataatagttcactaaaacatgacagatttaaatattttctgcaaagtacctgctaataaataatacagtaaataatcaggctttaaacacctgacatttaacaagctttgtaaatttgtccaactcaagtctttctgctccacagttatttttgccactatcaactgtaacgcatcttagcggattccacttcaggttgtactaagttagtgtttgctcaacttttctgaaaatattttctcttgtagttgtttcacatagactatgcataaacactaattcttccatcacttcaaactcagcactaacttctggagtatgtaacaactgaacagtactggtaacacctattcatccatcaaaagcctaagaaaaccatgaaaaatcattcacccttctttccaaaatgacttgatattactcccaacgtccttaacttttagagcaattactctcgctgaaaggctaatagtcttttttaaagtttattttctatggacacatctttgtttaccttaataaaacataatttaattaactactgttggtaatggttttccttgcttggctaacaaataagccattgaaaaacttactttaattatagcctaatttccattttttgtttttgagaagaaattctgctgtgataaaattttgttttaatttactatttttttttctgaccttttagttttattcctgttggctgggaatattgtgagaagtgccaagtctggtaatgctgacatatattatattcttttagcacagccatagtcttctagcataataaatataatgctttgctatctaatttgttaataataatatacattccactatacctctaaagtgttacatataaagtccacttttctccttttcttgttttaacatgataggtgggtatgcactggtaatgagagaaataaataagatgccagggcaatatgtgtggcgcgcacacacacacacacatactgacaaactgtaactatgtcattgtgattcgtagcatgcagagcagcaatttgaaatatatgtgctctctgcagcaaccaactctgacactgtagtgcaacagaagtcatatataatgcccaaataaatgggtgtggttttgttcccataaaacattagttttaaacactcatacctgaatgtcgttatgatttcctgtgtcataaaatattattcccttttaaatttttttcagacattttaaaaggtaaaaaacatttttagctcatgtcccacataaacacagctggaggaccgaatgtgaccccacaggctgtcatttgctgacacctccatccacccctctgtagccttcagggtcctaaataaacttctatagcatttaatgacccctaaattccctttttgtcttcccagctctgcagactgccagaagcttctcagcttttcaacctctcagctggatttttttgaactgagtaattaactcaaggggaaaagaaaatttaaggtcaggccaaactctgcacaaccttaccctctgaattctcactccctcaggtcctcaccactcttctagttttctgatcccttaaatatttatttgaaacaacattttatacagcttttctaattgttctcagtggaaaggctagtctaaaccaagtatctctgccataggaagaggtggaaataacacttatactaccgaatagaaagacttagtataaagctacagtaacaatgacatcatgatatatcactgggattctcaaatacacaaagaataaaacagagaacctaccaacaatctaaaatacattgaacgtttgctatataataggttatatttcaaatgtggaggaaaaagatgtttcaataaatggtgtagtaacaattggctgtccatgtgtgaaaaaatgatactggaccccttatatcacatgatacacaaatcaatttcaaatagataaaacacacaatagtgcacaactagagaaataagtttttgaagtatattttcaaaacaagttagaaactgttaaaaggtttttaatttttgaaataaaaacattaccatggttcaaaagttcctaaagggtatgcagtataaaatcactttgtatacaactatataaaataagtttcctacaggcaaagaattttaccagtttcctatgcatccttcacaagatattttatgcagatgtaagttcatattattctccacccctcccctaaactttacattcaaggggtcctttacaataccaaagaataccacccacctcatcacaaaggtaagttcatttctttaaacttatttaatactaaaaagaaagattaaaattaaattgagacatcttcattgaatgggcctaccaaaatttaactgtttttaaataggcatacaaaactcttaattttctaaaacaaatttttcagcttcctcttagctccagagtcaaggtgtcaaggtgacgggaaataaacatattcattcattccctcattcattcatttttgagacaaagtctggctctgttgcccaggctggagtgcagtggtgcaatctcagctgactgcaacctctgcatcctgggctcaagccatccctcccacctcaacctcttgagtagctgagactacaggtgtgcaccaccacacctgcctttttttttttttttttggtacttttagtgaaaagacagggtcttgtcacattgcccaggctggtctcgaacttgtagctcaagttatgtgcctgcctcagcctcccaaagtgctgggattacaggtgtgagccactatgcccagccacatcaatttttaagtagatatatgcctaacggcattccaaggtcaaataaatatctaggattatcttgctgtaccgacaccttgcacttaacattgtgatgaaataatccattgttaattttttgatgccttccttctatccctgcatttcagagtgaaaagataaaacaatttcttactgtgtacatgatgattgagtactgacaggtaacatgacctggggaagaagtcacttgacattagctaacaatgtcagagacagattaagaagtgaagactcccgattgcttcccattaaaaataataattatgaccaggtatggtgacatgtacctgtagtcccagctatgtgggaggctgagctggaaacattgctagagttcatagttgcagtatactatcattacatgtgtgaatagccactgcactccagcatgagcaacacagcaagatccctctctgccggacccgccactcccaaaatagaagactctatctcttaaaaaataaatattattaggttttatttagaaacttttatttagaaaatcttataatacaaaaacacacttgagaggcatttgagattattgaccatacctccttaaatctattaatccaaactactataatttctactatacttcctgtaacttattctgtgttaacatccaccttttcactggttcttcctcagagcattgaccaaaggatcaatcttccatcttcttttctcttcttgttctccaaagtcagtttgatttgccaccactgctagttaggaaaactgtctatgattcctaccctgacatttagtgtcaaagccatttcacacggtttcaggctcagcacaaccaaacaaaacttgtgatcttccaacatacttagacttgaaaaaaaagacatctgcagttcctccatctaatttataaagaatcaaatactatgcattctattacaatatttcatctttatgttttacacataatacctaaactcaagattttacactcattggcctttaatttatagcagtaatcctaaatatgtttgtcttcaagtaaaccttttccaattcaattacaaagggctgggggaatttagatcatttaatactgctcttcttatttaaaaggtacattactgaaattcctcatcttggtatgcaaagccaaggaaattttccattcctgtcccctagtattctctaccctacttattctccagtcattcttacgtatgtgccatttttccaaaatccatataccctcatagtttcaaaccctgtaaagggtgaccctctgtctagaatccctatgttaatctactgaaacttacccatcctccaagcaccaccttaaatctttccttctttaaaaatattttcagattccctcagttaaaacatatttccaataatagacactgtttattgcctataaaatatccattccccctttttccttcctacagatttccactttttcagatacgcaccctgctctaagcagaaacatgcttcagaggggctaaatactctccccagcctcagaggaaagccatcatggctgtctcaacttctttatcagttattggtttaagatatgaacgctcggctgggcgcagtggctcacgcctgtaatcccagcactttgggaggccgaggcgggcagatcacgaggtcaggagatcgagaccatcctagctaacacggtgaaaccccgtctctactaaaaatacaaaaaaaattagccgggcatggtggcgggtgcctatagtcccagctactcgggaggctgaggcaggagaatggcgtgaacccaggagacagagctggcagtgagccgagatcacgccactgcactccagcttgggcaacagaacgagactccgtctcaaaaaaaaaaaaaaaaaaaaaaagatatgaacactcaaggtaattctagctaataaaatgttaagaggaatatgccaggggcagggcgtggtggctcacgcttataatcctagcactttgggaggctgaggcgggcgggtcacctgaggtcaggagttcaagactagcctgggcaacatggcgaaaccccatcccatccctactaaaaatacaaaaattaaccgggcgtggtggtgggtgcctataatcccagctactccagaggctgaggcaagagaatcacttgaacctgggagacagaggttgcagtgagccgagatcgcgccacttcaatccagcctgggcgaaaggcgaaactccatctcaaaaaaaaaaaaaagagagagagagagagagagaaatatgctaggatgggacaagcatctggcaaggatttttccttaattaacataataataaaaaggttcctttttcctttctgcctctgaatgctatcctgagagtacaatgcttagaggtcctgcccactatcttttgctcatgagaggaactggatcaagaaagagaccaatatgttctggatgcaccaagaaaagatgttaagaccctgacaacttgttatcatgaagctactgaactacccatcaccctaactcctaattttctattgtgaaataataaacttcttagttacttgcataatacttctaattctgaccaagatggagtcacagagaccggattatcggatttacgctcctcctgaaacaaccataaaaaatgaagacatggcagggcatggtggctcacacctgtaatcccagcactttcagaggctaagacaggtgcgtcacttgaggtcaggagtttgagaccagcctgacaaacatggtgaaatcccatcaccactaaaaagaaagaaagaaagaaaaagaaagaaagaaagaaagaaagaaagaaagaaagaaagaaagaaagaaagaaagacagagagagagagagagagagagagagagagagagagagaaagaaagaaagacgtgaatatatgtgaacatatatatgctatgtgaacatcaggcaacaaaggactgtagagctttgagaaatgagaaacaaaagaggtgagccctacatatgccccagcacacaacgataagagtttccaggccatggcatagagagtggcaactgaggcaaatctcagctgactcctgagttggaaagagaaagttaagagccaggagagaaaaaagcagcaaggaataactgcacagaatgctgagaggagacagttgcatagaaaagaaccccagaggtctatagagatcttctctcaagcattcaccagataactgatcagcatatgcatatgaggaaactatgagaatccagaaaaagaaccatcagaaacaatgggagggaacagggcctgatactcatacaaagccaggaatagtatctgttcccactagccaaactgggaaaactattaattcatggaacattcaacagagtccacagaaagtcttgcctcagtggtgaggaataattagtcctggactaagcactccttcatatctgtctaataaatcataaaaacaaaacccaaaagaatgaaacggtttataagtaactcaactacatctcaaaacaaagctcaagaagatttatagaataaagaaaatagccagaacccaaggtaaattttacaactaaataaagattaccaggcataaaaagcagcagacaatcatgatgcaaactgaaaataatcaatcaaaactgacccagaacttaaatagatgttaaaattagcagaggaggacattcaactgtttttatacatgtatcccatataatcaaaaagttaaatagagacatgggagataaacaagaaaagccaaaatcaaactttcaaagacaaaaacatttgagatgaaaattacattggatgaactaaagcagattagaaactgcagaagaaaagattagcaaacttgaagatacaagaacagacactagctaaagtacaaaaagaaaaaaaaaatcttaaaaagtgatttttaaaaagcatcagtgagcagtcaggcaacttcaaatagcctaataatatgcaggtaactggagtccccaaaggagaaaaaagaggaagagaaaaaaaatacttgaagaaacaactgctgaaaatgttctagccataaaaagacctattaactcacggatccaagaaactcagcaaaccccaagcacaagaaacatgaagaaaattacattaagggataacataatcaaattgttcaaaatcagggatatattattaatagcagctgtataaaaagacatgttacctatagaagaacaaagataagaacaacatcagatttcttttgagaaacaatgcaagtgagaagacagcagtacatctctaaagttctagaagaaaaaaggccaactagaattccatgcctggcaaaaatatctttcaaaaatgaaggtgaaataaaggcacaccagaaacataaataatgaaataattcatcaccaggagactttcactgcaagaaatgttaaaggatattctccagaaacaaaatgatgtcagatgaaaatctggatcaatacgaaggaataaagagcaccacagtggtaactatatgagcaaacatcttttaaattttttattatttaaatctctaagagatatatgtttaataaaagacagcaaaatattacagagtttataacatatataaaagtcaaatgcatggcagcaatagcacaaagtgcacgagggaggaaaagaaagcaaatgaaggaatgcttttattatagatgaagtgtacaatattacttgaaggtagacctctctaaatgtacactataatcttaaagcaactacaaaaataatttttaaaaacaggtaaaagtaataaaaagaggcaaactggaatcataataaataatgtaggctgggcacggtggctcacgcctgtaatcccagcactttgggaggccaaggtaagcggatcacaaggtcaggagatcgagaccatcctggccaacatggtgaaaccccgtctctactaaaaatacaaaaattagctgggtgtggtggtgcacgtctgtaatcccagctactcaggagactgaggcaggagaatcgcttgaacccaggaggcggagactacagtgagccgagatagcgccactgcactccagcctggcaacagagcgagactctatctcaaaaaataaataaataaataaataaataaataaataaagtaaaagaatccaagaagaccaggtgcaatggctcacacctgtaatcccagcactctgggtggccaaggcaggagactcacttgagctcaggagtatgagaccagcctggacaacatagtgagaccccatatataaaaaaataaaacaaagtagccaggtgtggtggtgcacaactgtggtctccactattgggaggctgaggtagatcacttgagcctagcaggtcaaggctgcagtaaggtatgatcacaccactgcactctagcttgggtgacagagtaagaccccatcttggcaggtgggggatgcaagaaaaatgatgcaaggaacagatagagataaatagaaaacatataagaagacaatcacattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataatatacaccatgcttacgctagtcaagagaaagctagagtagaaatactaatatgaggcaaagcatatttcagagttaaacacaacatttttctactacttgcagtcaaaagtatcattaacagtctctttactctgctcaaagttacaaagttcttttgtataaacattagaacacttatcacagcctgtctataatggagaataattcaatgttatatactatacaacactcttactatagtccattagacagaaatatgtagcatttgagacaccttccaattataaaactctatgcaaacaaaaattaacaaagcagatctgagactattacattatcctgtgaaggagggtctgtctgtttgcacagttggtcctaggctggcttctgagaacttgaatttcaagagggttccctaactggtaatcatggtttactatatctagactatggaaataatgtggcttatcctgctattctttttatgagtctggaaatttcacacatgctaggcagagagtacacctacatgaccagcctagataaaaactgtgtttcttgggcagtcacatatgttgttgtattttcgttaagggggaaagaaggtagtctgtgtgatcctcatggaaggcacagcacataaggaagctggtacatggatttttccagactctgtcagtgtcttttgccattgaggtctttctactatatatccatactatgttacagtaataaatcttagccattacaaccctaagctgatcccatgagtccttctagcaaatctccaaacatggaggcagtcttgtggacccctgacacaaatatatggttgtgatctcttaaggtttatccttcctcttaaactataaagagctggccgggcacagtggctcacgcttgtaatgccagcactttgggaggctgaggcgggtggatcacgaggtcaagagattgagaccatcctagccaacatggcgaaaccccgtctctactaaaactacaaaaagtagctgggcatgctggcacacatctgtagtcccagctactcgggaggctgaggcaggagagtcgcttgaaccagggaggcagaggttgcagtaagccgagatcgcgccactgcactccagcctggtgacagagggaaacttcatctcaaaaaaaagaaaaaaactataaagggctgggcgcagtggctcacgcctataatactagcaccttggcaggcccaggtgggagaactgcttgggcccaggaattgagaccaacctggaaaacagagcaagaccctgtctcctaaaaaaaaaaaaaaaaagaaaagttggccgggtgtgatggatcacacctgtagtcccaacactttgggaggccgaagtgggcaaatcacaaggtcaggagttcgagaccagcctggcccacacggtgaaactccatctctactaaaaaaaaaatacaaaatattcgctgggcatggtggtgggcacctgtaatcccagctacttggaaggctgaggcaggagaatcacttgaacccgggaggcagaggttgcagtgagccgagatcatgccactgcattccagcccgctgacagtgtgagactccatctcaaaaaaataaaaaagaaaagaaaagaaaagttagccaggtgtggtggcatgcatttgtgatcccagctactctaaaggctgagacgggaggactgcttgagcctaagaagtcaaggttgcagtaagccatgatcgtgccactgcattccagcttaaacaactgagatgctatctcttaaaaacagaagtagaagcaaacaactataggggaaaatgagggatacatactttaagaatttctaaaaatttacatggaaaaacactaggattctatagaaaataaaacagtattaaataacattatttataaaatagatactagcaaattaccttacgtaaagattcaagtcagtaacttaaaggatcttacataaaagtactttccattggttggaggagagacttttactatacactgtttttcaacttttttagacaaattacatttagaagtttaaatttgcctatctacattcttaatgtgaattgccaccttactataggaaggctatttttgtttctgcagtctacaaaaagaacaaaaatattaaaaacgtacaactcttctcacagaactaagttggttttacacaaagacatctggcacaaaatacaatgaaatttcaatatagaattacagcaggggatgagggtggagaaggaagagattaccaattctatgaggggagacaacagaagtatttttttaatgtcttattttaagagtaaaacacctggttttttttgagatggagttttaggcaggagtgcaatagaacgatcttggctcactgcaatctctgcctccaggattcaagtgattctcctgcctcagcctctcgagtagctgggattacaggcacacgtcaccatgccaagctaatttttgtatttttagtagagagggggtttcatcacattggccaggctggtttcaaactcctgacctcagcctcagcctcccaaagtgctaggattacaggcgtgagccaccatgcccagccaacactgaacattttattcagaaatagttaagaaaacagaaatatacattgggggtttatggattacttctttttggggggcaatactgggaatagaagagaaaggagcttcctttccctttccttctttcattcattcattcattttgagaagaagtcctgctctgttgcccaggatggagtgcagtggcgaaaactcagctcactacaacctccacctcctgggttcaagaaattctcctgcctcagcctcccaagtagctgagattacaggcacacaccaccacacacggttaatttttatatttttttagtagagacagggttttgccatgttggttaggctggtctcgaactcctgacctcaggtgatccacccgcctcagcctcccaaagtgctgggattacaggcatgagacgccgcgcctggccaagaaaggaactttagataaataaaatgattaaacatttgtagcatgtagaatgaaaatattccctcagtaatactcaaattatccagatttccaagatgttggtagcaccctgagagcttcaaaagggaaattaaaagaaaaacgacgttacccttcctgaaacacagattcactgtttgccatgttcttttctctagtaaaaaatgaataaagtttcccctggaaaaactaaaaacaatctgaggtatgtttcagagaaaacaaaattgcttgacaaaaatgccatgttaacaaccgaggaaattactttaaatatattaattttaacacaggaataatatgtcaaaccaggatttctcaacctcagcactatcggcattttaagctgtatagttttggtgtgggaggctgtcctgcatattgcagaatgtttagcggcagtcctggcctctacccaagaggccagccagtaggacctacctcctcattcaagctaatgcactaaattttgcccttcattgacaaatcccattaatgcatgtatttatcccattagtgactctcttgtgttccagatactttgttaggcaccagagaaaatatgataaagcaaaacagctattttcctcactctcatggtgcttacagccatggtgggaaaaatccatagaaaaagactcacatacacaaatgcagacagaataaaaaactcacacaaacaaacgctgcagatgttaagttacataaaggagatatgcatggctgtgcatggtggctcatgcctgtaatcttagcacttggggaggccaaggcaggcggatcacctgaggccaggagttcaagaccagcctggccaacatggcgaaaccctgtctctactaaaaatacaaaaattagccaggcgtggtggtccacgcctatgatctcagctacctgggagactgaggtgggaggatgacttgggcccaggaagcagaaggtgcagtaaactgagattgcgccactgcaatctcagcctaggagacagagagagactatgtctccaaaaacaaaaaaaaagagagagaagacatacatattccactgagaatgtataataaagctgcatactcaaacatttcttattaaaagatgtgcacaatcaaaaaatttacaaaatactgcaacccctcacctgagctttatagtatctcattcccttccattttcttagattaaaaagcctaattctaactttggtttattttaatacctagtttctatggctctcataggtttaaaaaaacaggttctccccaaaagtaaaatgatctaattagaagtagtacatgatttctgcaaccatttttaaatctcaaccgaaattatcaaaatttaagcaaataaaatttcaccctctctaataaaaatattgaatgtttaataaatgggcttaaaccagagctctttagaatattttaaacatatcagaaaattccatgttcaagtttcttttaaggtgacaaacatgagagttttttgttttgtttttacaaccttcattatttctgacaataaaatatcaatataaatagttcaaaacatctgttttcaaaatgttcaacgccccaggacatgtttctttgaaaagtcactgcattctcaatgttgaaatgtcatctttatcttgaaggggcaggttaagtgtttgttttctttgaaaatagagctaggtatcagaatatactcagctacataataaaggtcagcaaatttcatttttcattttttattttaatagagacgagatctcactatgttgctcaggctggtctcaaactcctgggctcaagaaatcctcccatcttggcctcccaacatgctagaattacaggtgggaggcactgcacctagccaaggtcagcaaaatcgaccttttggcaaaataaaaacgtcttctaagttcaatagctatatcgcccctagggaaacttttgtgatagcagaaattttccttggctcctccttcccaatcatttctgtagaactgtaaagatttgctctatttagagattaagtatataaactttcatgtaattagccatattgataacctccagtaacacttttgggtacttagaacttatttgctgcctatgaatgattccatgaatgatcttcagtgctattaattagtctacaaatattcactgaggaataaccaaaacagaaaaaaaccccatccgaatggcactagtatactagtgagagggagatgaacaataagtaagattattacgtgaatatacactctgtcagaggtgataagtacgaaaaagaaaacaaaaaagcagatattatgggaaggcatttgaaatctttgacagcaagcctagcaaaggcctcactgtaaagtcacgcttgaataaatacataaaggatatgagggggcaacacatgcattatgaaaggccctgaggtggatctgcgtctgcgtacttgagtaagaccaatgaggtcagcatggctgaaggaagtaaatgaacaaacggttatagtgaaagatgtctgagaagtatacgtgaggtgtggtgaagatcatgtagagccttacaggttagcaaggaatcttttttttttttttctcagaataaaatgggaagtcactgaagagtgttaagtagagcagtgacatgactggacaatctatttacatcagtatggactcgtgtacttattctatggatgaaaatgcaatattatcattatttttgtggttgctaaaattggtccagttcttaggagctccttcaggtaggttcccgtgctttgaacaggttttcatctttttaagcacttcattactttctggcaccacaagatgatctaggcttaccttgtattttctctgcaccagtcccgtaaggaactacttctcaaggagccctggttcctttcattgaagagcaatggttggagaccaagatctaagcactaggtattctcaatgctactggggtgtcattgtttctatgccctctcaggggatagaggtaggaaatacacatattcaaattaactcatacatatgcacacatctatatttctgtatgtctgtgtaaatattaaaaaacatgagtttattttcatacttctgatctcaacactacagcatgactgtacagttctttttgcctctagttttatgttatttaatcaagacactattttctacagttacttaggtgagttctttccctccctatcctcttttatgtgaattttactattcctttttgggttctcctgcatctgggtaggtggtaattgcttatttggtctcccacatcctggttggtggcaattgcatagaagcatttaaaacattcctatggttctaagaatcagagttatactgacaaatatactctgagaagtgccactcacatttcatccatgctacacagatctccactcccttcttctccctcccactccctacaggtaaccaatctctagtttctgatttatctgcatggtactccattatatggctatatggatgtaacacagtttattcaaaccttctcctctgtgtgggcatttagtttgtttccaatatttcgcaaattaaataatactataattaataacattaagtaatacataatttgtattgttagaggcatattcagcatagattcctagaataattgagaggtaaatgcatacagtttgttaggtatcaccaaatttccctccaaaagatgtgtaccaatttgcatctgcagcagcaaagaatgagagtacctgtttccccacagccctgtcaacaaatgtgttgttttatgtttgaatttttgccagtgagacaagtcttcctttcttgagacaaagttctagctaactggtccatcttgtgcctatttgataatgaagaataatgaacaaaagccaggcgtggtggcacatgcctataatcccagtacttcgggaggatgaggtgggagtatcgcttaagctcaggagatagagactagcctggacaacacagcagaacctagcctctacaaaaaatttaaaaactagttaggcgaggtggcgcatgcctgtggtcccggatattcgggaggctcgggggagaactgtttgagcctgggaagccaagggtgccaatgagccgtgatcatgccactgctctccagcctggacaacagggtgagaccctggaaataagggaggaaagaagaggaaggaaggaaagaagagggaggaaggaaggaaggaaggaaggaaggaaggaaggaaggaaggaaggaaggaaggacggtaggaaggaaggaaggaagaaagaaaggaaggaaggaaggaaggaaggaaggaagacgaaggacagaagaggaaggaaagagggagggagggagggagggaaggagagagggagagagggagggaaggagggaggaagggaggggagaaggaagaaggacaaaacaaacaaccgtacaaatggcgacacaaaactgacactcctgtgagttttgagtgattcaatctagtggagaggtaaagatttgacagagttaccactagatcccttctaatccccacatggtctaccaactccaagtactcaatctgcatttaacttgcttaggcccaccaaattctaatgcctaaacaaagtcggaagggatgcaatgtctcctaagggcttgtgattcctctgccagtggtaggacacagtcttcatctctaaataccatttaattattaatcagtaagaacaaaaatggtaacttctgtccaaaagggacagagtgaggcaagttttcttttaactaccttcctagcaaacagaggtaggaaatacatggacacatacaaactcatgcaaatacatacacctacatttctgtactaagtatcaaacactacgagtttatattgattcctctggttctaatccaccaccaaaaagctcatttagcctttgttaccttccctgtaatacttttcactgtcacaaaatagcccaaaataaaaattacttttatgaagtaattcataaaacagatggttttcactgaaatatcattgtcttaatccagtctctaagaatgttcaggctggggaaaatactattatgcattaaactgttcaaaatttgatgacatatacactttaatgtaaaatttccaaaacaagcactctgacttcactactcttgaggtgatgcttactcatctatgtaaatcagttcattttgataatccaagtaaagctaatgttctaatgattgaatttttacttgaatctaagtccttgtctcaactatacttttgaaagctttgcctatgttctatctattaaagcccatatagtttctaaggtcaaaatttccagttttaatattccattggaagggctgtctcacttctcccaaatatacttgttaaaaaccaaaggggccaggcacagtggcttacacctgtaatcccagcacgtcaggaggccaaggcaggcagatcacctgaggtcaggagttcaagatcaggctggccaacgtagtgaaaccacatctctactaaatatacaaaaattagccggtgtggtggcacgagcctataatccaatctactcaggaggctgaggcggcagaatcacttgaacccaggaagcagaggttgcagtgagctgagatcatgccaccacactccagcctgcacaacacagcaaaactcctctcaaaaaaaaaaaaaaaaaaaaaaaaaaaggaaggccaggcacagtagctcacaactaaactcccagcactttgagaggccaagaagagaagagaggatcccttgggtccaggagtttgagaccagcctgggcaacatggtgagaccccatctctacattttaagaaaaaagaaaaagaaaagcaatttgtagacagcaaagcagtatcacttcacagagtttgctgtctttatagatgggaggaagccgtttcatttgcatttgtttcaaaattacatgaaaatcacaggaaaagctctgaaaaatggcagactatgcacatattactttgatacaatgcaataaagatgaactgaactgctgaccgaactaaaaaaatttttttaatcactttttaaaatatcaaacagaggtagtccacattatggactaatgaccttcaaatcttttcaaatattttctttcattttaaatcattatcaaatagttttgtcttaaaaagttaccacatgaatgtataagcatagtgcaaaattttcatttctaaaattttaatttctaatttaaatgtaaactacttattttaaaagattcaagttcactgagtaacatactacattccaatggcttacacaaattaatttttttttttttttttttttgaggcagggtctcactccaacgcccaggctggagtatggagtgcagtggtgcaatcatggctcactgcaacctcaatctactggactcaagcaatcttcccacctcagcaccccaagttgctgggtctacacatgtgcaccagcatgcccggctaatttttgcataaaataactttttttttttttttttttttttttttaattaaacggagtctctctctgtcacccaggttggagtgcaatggcgcaatcttggctacgggcaacctccacctcccagattcaagcaaattctcctgcctcagtgtcccaagtagctgggattacaggcgactgccaccatgcccagctaatttttgtatttttggtagagaaggggttttaccatgttggccaggctagtctcaaactcctgacatcaagtgatccacccacctcggcctcccaaagtgctgggattacaggtgtgagccaccatacctggcctagaatttctcttaataaaaattaataatttcctattttgagagcttttacactacagcaatcatttaataatcctttcaagtgaacttctgattaaagtgaatgttataaaactatgatttaaatatttgctttgtctacttacttctgtgctccctgagacaacagctttgtccacgttcactaacaatggttcttccatctggcatactcctagtgaccactccacacaacggtgatgagcccaacaagtgcctaaaatgggaaaaatgaaaaggagcaaatgagcaaacattaaaaaaattaaagctaataaataaagacataaaacttcaaaatcaactctaatatgtaaatatacaatggcatcctgtatttgtgatagcagtaaagtggcccttctaaaaatgtggaccaaccactgagtgccagtatcaatatcaaactgagaaattcttagaaatacagaatctgtctgggtgcagtggctcactcctgtaatctcagcactttgggaggccaacgctggtggatcttttgaggctgggaacttgagaccagcctggctaacatggcaaaaccctgtctctacaaattagctgggcgtggtggtgcacgcctgtaattccagctactcaggaggctgaggcatgagaatcgcttgaacccaggggacagaggttgcagtgagctgagatcgcaccactgcactccagcctatgcaacagagcaagactccgtctcaaaataaaaaccaaaaaaatgcagaagcgcagatcacaagtgagatctactgaatcaaaaactcgtgcagtggggcccagcaatctgtgtttggttctgtttttttttgttgttgttgttttgttttggttttgagacagggtctcactttttttgttgcccaggctgaagttcagtggcatgaacacagctcactgcagcctcaacctccagggttcaagcaatcctcctgtctcagccttgccaaatagctgggactacaggcacatgccaccacactccgggaatttttttcattttttgtagagacagggtttcaccatgttgcccagtctggtcttgaactcctgagttcaagcgatccacctacctcagcctgccaaagtgctgggattacgggctgtgagccaccgtgccctgccagcaatctgtgatttaacaagccgtctggttattatgatgcacacacaagtttaagaataactgaattagtgattatttcttcaacaaacaaaattagtttttagtcattttatttaaatattatatatgtatttgatatgtttctggtatctttatataaagcaaacaaagtattacttagtactttgttgaggtgatatacaaaggaaatgtatagaaaataaactacacatacacctctacttccctcatcccacagtgagagcacgtatcaatgattattaacacttcagcctttaaattatccatcacataacacttgaaccactatcagtcaatctgcagttcaactacagaatgagatgtactttaaattccagtagcaccatatcatgagtgctgagttacaatactgttataataagataatctacccggctaagacctattttcattcatgcccaaataaaatagactcagaatgccacattccccaagttctcactttaaaattttcccctttaaaattttctcttttctcaattgtcagatctccatggcaccgctatctacacaagaaaaaatacaagtattttaaaaagcatccagtccggtggtggtactgtacagattttaaatagataaaccttttcttttacctaaccaggcatatttaataatgatttttttatagtatgattataattatttctagatgaaaggtatttattattgaggacattaataatgtattaaaattaaaatgcttccagaattaagaggcagtcattattgaaaacatgcccatacctgtagaatcaaataaggcttggatatcaatggcatctggaagcccaaccagactgagttcatcccacagtttaccagcttgatcatctgaagctgtctgggtgcttacacttacacaagatactatattctgctgaggagatcgttctctgaaaataaaataaaataactgtgaaagtgaaaacaagcagaaaattgtttcatttttaactgtttaaatgcaatgtactgccaaatcaattttaatttatcagccattaactgtcataaaacaacttttagaattcatctgttagtattatccatggtataatattaaactgggttgccatattatatcgtataagtaacaagtaagaaaaagagtctccaaacccacagggaagtattaaattgtaaatttgtttttccattccataatataatgtttttaaaaccaactctcatatcctagtcaggaattgtatttaacacataaactgagtatttcctttggctttacttaaacgcttacaaaacaaaacttgatcaaatcagaaatgtttagtctgctgtatcttgactgaggactgccacaacagaggtggcagttaactgtgtaaagaaaggatattttccagggaaaatgaaaacccactacagagtgtgaaaacagaggcaggaggaatggaatgtatcagctgtagctttcttatggtcccgtcaacaaatctcaacagctggtctgtggcatgacgttgcaagtactctcaatcaagactgtatgtcacaaattggaagtaaaaagcaaaagcaaaatagctaccaaaggcatgtagaataaggaagatagtataacagcaaaaactatagtctaaaaaaagaacattgaataaagtaaacaacatatgggagatttcaggctttcaaggtctaacactttaggtattatttaagaccattaaataaataaaaatggctattgtacttaattattaaatatgggaaatcagatgactaccactaaaacttaaatcttctcctaatatcatagtatttaacctgatcataattctggattaaatcactattgaatatagatcataactcactgcacttctgtatgctggatatttatcatgattcctattaagagaaaatcagcacaatgaccagggtactaaacatttttatacctggaatcattgaaagaaaaaaagtattaacatatttcaataagtacatttaaatatcaaaccatataaaaataaccagtaatgtttttatgttcagcattagaaatgcatagactttttttaaaaggtatagcatgctatgctaactttaaattctcattttaataaatgcccacagtaaaatgagaacaaattctttcctataagtataatctctattcctacaaatatatgctccattacaaatcattgttattttattgggagaaaaaaaaaagaccaacagttcatctataactactaaatgttgttttagcatactgttttgcactagtatttgatgagggaaaggggtgtaaaaaaaccaagagaatgactaatttattactaatcaggtcctaaccagcagcttaatcaaattcaaccttcaagttttgagactggtttgtatgtatataccatatcagtaagatatcaatgtcaacactaaggatgacagcagcccagcttagaaagagatatcaagaggaatcagctgaaatgcatacccacaaaattcttagttataaaacaaaaaaaggaaaaaaattcttgatttttttatttagtgaaaatgagcaaagacattttcaaaacctttgtaaaattgttttttaaattaactagctatttaaacttcattagcaacatacattttgtaaatatttgaaatcattaccaagctaaattaattgcctacccttcaatgatgccaaatttttaagtgtacttcattaactgccatattatcattacttattaagttggtaagcactaagtatatataaagactttcgtttaacaaaggctatttttatataattatctgagctcataagaattttcactaaaaattaatttcacttttaaaacaaggaaatgaaaccaattccatttctcaggagaggattttatataattgccattatttaaggcagaacatgaggatataagatacagcctgattcactccattaaatttgctaatagacattttaagtttgctggccttttgattattttattaagatgtgtgtactcaactgacaactaaagaaaaagctatagcctccaaaacatcacaactctccaaatatagtacttctaagtttccttaaactgttccaccttaaattcttttaaaagattctccctctttttattgtttcatttcctacttcaggtcttcaaggcattggcagcagttcaaaacaatgagccaatcaaataagtacaacacaacaatgatttagtacttaaatttggatataagccagataagcacttgagtgattacatcataaccctcaagaggcagtgttagctttgcaagctaaattaatttttacacattctcatcaactacagaaacttctactcccttaaccagcacagccaagtctccatattaatatggtctttaaacacaactgtacaaaatattttaaactatatcagacaagacctttaggtaattacaatgtgcccgtgaatacagacatacacacatcattacaaaaaaaaaattccttaaaaaagaaaaaagcatcttctgggagggaaggcaggggagggagggagggaagaatgtataggacagtgcaacattttctgaagcacacaaacttatatataaattaaataaatgactgaatggattgatgaatgaatgacacaaaagacatgagtagtgaaaaccaattctggatttgctattgtattatgttatattcttaaaattaaaagcttatttagagaaacaaaagaaggactttattgatctgttttattattacattatttccatttataaattccatgaactccctccctctcagcttgtgttatgttctttgaagttttcttccaaaagtttagttttgtgatcacaccgctttcatatacaattaatataaactttttaaaaaataacaagaaaaatttgtgaaaaggatagtttgttggattaattgggttaatggtgagtcagagtatcccataaatgtggagaacaggagaaactgttcaacaagaacaatcccatttgaaaatttataaacattataatggaaataaattatatgcagtcttaatctattccaacatttaaagtcgaaactgcttactttctctgtcctctttgttttcgtggtgctgagttttgcattttctcataggttccattgctgttgtcatcaatgtccttcttgttagaaggttggtttctccatggcaagataaatccaggcgttattctgaattgttttaagtctccttgtcctaaggaacttttttccccacagtaacaaaaagcgcagagctgttcactagtaaaaatgaaatgtaagtcagagaaggagaaaagtagctttattcaactgctttaagcgataactatagatacttgtgcttttaaattatgtctaaagcacaagctaagcttttcaatctattttctacagtctattcagtgattacccataagaacaattaagtttaataattatacatttggaattctacttttccatagcattttaaaaagtagtacacatatcaaatccaaaaaattctagttagcagttagaaaagttattttcttttatatttgactagaaaaaaatccaagtaagaaagctaaaggtgggggccaagcacggtggctcatgcctgtaatcccagtactctgggaggtggaagttcgagaccagcctgtccaacgtggtgaaaccccatctctactaaaaatacaaaaattagctgggtgtggtggcacacccctgtaatcccagctactcgggtggctgaggcacctcgcttgtatccgggaggtagaggttgtagtaagctgagattgaaccactgcactccagcctgggtgacagagcaagactctgtctcaggaaacaaaaaaaatgcaagttaaaaatgggaaagaaggtagagtttagtagccacccaactgtatgacagttctgtaaaacatatggtgacagttttatttaaccacttgatagaacgttcattatgcatgatatatatataccacacacatgcatacacacggggagatataaaaatataaacttaaatagttcctgggttgagtggtagtagatttttagggaagcagaagagctgaactggaagaaggaaagggatgattaggagcaaaggggattttttaggccagtgaaaccattttatatgatactataatggtagatactgagccctaatgtaaactatggactgtagttaaaaataatgtatccatattggtttaccaactgtaacacagcacacaatactaatcatgagggaaactgctgggggtagaggtgggagaatgagctcaatttttgtgtaaacctaaaaatgctctaagtctattaataaaaaaggagaaaacattaaaaaattaagagacaacaatcaatatacatatatagaatatacacttactaagagatcttagaaagaatgaaattaaaaggactgcttcctcttgattatatttacacttcacaagatatttactgctgctatacccaaatcctccttcttgggcattaaagttacctctacagtatttaccccatgatcttacatatcttgcattaccaggtgatagaactaacctatagccttttgaggtgactttttaaaacttaggtttaaatcatattggactctcaactaattacttttatcaaaattagctttgtttttgtaataaattacctatttcaagttcatgagaaactatgttgtctgctggtaccgagacatacacaaattaaatgtagtgtaatttcaaaaaaaaaaatcaagtcaagttgaaaaagaaaatttcttctttccaaaaagagaccaccaccttatgctttgccagtatcttactatccccttatttgtaatgttctctgagctattaagcttacatttatttcaccatatcccatttctggtttgtttcttcccctagaaacactacccatgagaagcaacaatcagattgacattagtcttatcaacattgattgtaacagcactgattagaaaatggagcaatattttaaagctattgcagaaaaataccttagcattcaattttatattcaaaactatcgcttaaatgtgaaggtataataaaattactctctggcttagaagacctcagaaattttgccagacaacagatcaaaaatgaaaatacttttagagaagtacttaaattattaaagaattagaaaaggttgtatgaagtaagggaggtcaaacacctcagagtaatttattgttgacttttttttaatacgaggtcaagggaaatttctagcttttggtctggctgtagaaagctgcaaacaacattgtgcccaaccacacaacataacccaaccagagaatctgcaaattcacttttctgaaacccatcagagggcagaaatcacaaggcaaccaactcaccaccaaatgaaagacacttccataaagaaatgtgacaatagcacctctgaggaagaggccactgatatcataccagcagggtgataagaactcagtaaaaatttttaagaaattgctagaagccaagtgtgaaacacagtgagactatgttaacacctgtgaccaaagacaggggaattctaacccacacaaaggctcctcttcatgtacctcattagatgtcacgcactacagcaactcagccaggaacagtggctcacactgcaaccccagtgctttgggaggtcaaggcaggaggattgcttaaccccaggattttgagaccagcctgggcaacatagtgagaccctgcctgtattttaaaaagaaaaagaggatgggcatggtggctcacacctgtaatcccagcactttgggaggccgagacgggcagatcacaggtctggagttcgagaccagcccagccaacatggtgaaaccccgtctctactaaaaatacaaaaattagccaggcatggtggcaggcgcccgtaatccaagctactcgggaggctgaggcaggagaatcacttaaacccaggaggcggaggttgcaatgaactgagatcgtgccactgcactccagcctaggcgacagagcaagactccacctcaaaaacaaataaaagaaagaaaaaacatatatacagtgactaaaaaacattttctaaaatagcatacgaaatcttactagccattacaataatgtaaaccaaaaccaccaattaaaaggcaaaaatcaccaattaaaagaccatttttgagattagattaaaattagatctaacaattgggtgcagctgggtgtggtggcacacacctgtaatcccagcactttgggaggcctagttgggcagatcacctgaggtcagttcgaaatcactctggccaacatggtgaagcacacaccacccacccaccccctccccatctctactaaaaatacaaaaaaattagccaggcattgatggtgtgcgcctgtaatcccagctactcgggaggctgaggcaggggaattgtttgaaccagggaggtagaggttgcagtgagccgagatcgcaccactgccctccaacctgggcaacagagcaagactccatctcaaaaaaaaaaaaaaaaaaaaaataggtgcaaaaaatgttggaagtataaacacaaatgacatataaaacaaggacaaaaatgttgatgggaaaagaggtaaaaagataccaggcaaacataaaccaaaaggaagtttgagtggcaataattttatcagacaaaatgaaagttatgtcaaaaagaaaacatgacattagagatgaaaaagatgttacacactaacaaaatgatgaatagtataatagatatcgatcataaccatatactcagaccaacatgaatctggtctcaaaatgaatctcgaatctgaaagagatggttaagcatctccaatctgaaaatccaaaatctgaaatgctccgaaattcaaaactttttaagcaccaacatgatatcacaagtagaaaatttcacacctaagtacttaatataaactttgtttcaagcataaaattacttaaatattctataaaattaccttcaggctatgtgtataaggtatatacgaaacataaatgaatttctgtgggcagcaagccacccaggtgccgaggcaagagaccaagggcacgagctgttccagtataacaaaatatataaaataagaatagttatatagatcatagatatgattatacatgaatatcattaatcattagtttgtagcaattactctttattccaatattataataatcctcactctacaatcataacctaggaaaaaccaggccatacagcaataggagctgaggggacatagtgagaagtgaccagaagacaagagtgcgagccttctgttatgcccagacagggccaccagaggagtccttggtcccagcgtctgggaagacacctgttgccaagtggaccgtggtctagcggtagcgtcagtgtcaaggaaaaacacccactacttagcagaccgggaaagggagtctctaaactcttttagagtttagagaagactctactcctccacctcttgtggagggcctgacatcagtcaggcccgcccgcagttatccagaggcctaaccgtctgcctgtgatgccgtgctgcagtggtcacgctcctagtccgccttcatgtttcatcctgtacagctggctctgccttttagatagcagtagaaaattagtgaaagtactaaaagtctctgataagcagaaataatggcataagctctccctctccctctccctttccctctctctgcctcagctgccaggcagggaagggctccctgtccactggacatgtgacccacgtgaccttacctatcactggagatggctcacactccttaccctgcccctttgtcttgtatccaatacatatctgcgcagcctggcattcagggccactaccggtctccgcgtcttggtggtagtggtcccccgggcccagctgtcttttcttttatctctgtcttgtgtctttatttctatactctcgtctccgcacacggggagaaaacccaccgaacctgtggggctggaccctacaaatttcatgtttatacatgtctcccatccccaaaatatcttattatgtatgtgcaaatattccaaaatccaaaaaaaatccaaaatccaaaacacatctggtcccaaacattttgtttttgttttttttgagatggagtctcactccgttgtccaggctggagtgcaatggtacggtcttggctcactgtaacctccacctcctgggttcaagcaattctcctgcctcagcctcccgagtagctgggactacaggcacacgccacaacatctagctaatttttgtatttttagtagagacggagttttgccatggtggccaggctggtctcaaactcctggcctcaggtgatccacctgccttggccacctaaagtgatggaattacaggcatgaaccaccacacctggcctgtcccaagcattttggataggagaaactcaacctgagtttctcagaacaaaactggaagactaaaaaaattaaatcaacaacagtggaagattttaattatttttctcagaaaatactatgtcaaaccaataaaaattaagtattgaacatctttattgttcattatttattaattacctgagcataataaattagtttgagatactatattcagctctatctacaactaacggttcacattcttttcaagtatattaaaatatttcaagagtggattacatagtaggccataaaagaatacatgatacatagcaagtgaccaacatcatgcaggcaacattctctgacaataatgcagtaaaactaaaaatgtataataaatggataacttaaaatcttctggccaggtgcagtggctcatgcctataattccaacactttaggaggctgaggcaggtggatcacctgaggtcagcagtttgagaccagcctgaccaacatggcgaaaccccgtctctactaaaaatacaaaagttagctgggtatggtggcacacgcctgtagtcccagctactcaggaggctgaggcaggagaatcgcttgaacctaggaggtggtggttccagtgagccaagatcgcaccattgcatagcctgggcaacagagcaagactccctttcaagaaaataaataaataaataaataaataaatttggaaactagaaaagatattgtttaagaatctttcacttaaaatggaaatcccaatatgtgaaataaaatcataatgaaaatactgaatataaaattgatataaaatataaaatactgaatataaaaatttcaatatattactggaagtcctaggcagagcaatatggtcaagagaaagacataagggatcccagtaggaaaggaagaagtgaaactgtctttatttgctgatggcatgatcttatatatggaaaaccctaaagactccaccaaaaaactgttagaactaataaacaaatttgataaagtagcaggatacaaagtaaatatacaaaaatcagtagcatttctatatactaacagcaaacgatcctaaaagaaaattaatgtaataatcccatttacaatagcaacaaaaaaattaaatacttaggtgtaatttcaaccagggaggtaaaagacctgtatactgaaaaccataaaactcacaaaagaaatttaagaaaacatcaagaaatgggaagatatcctatgttcatggactggaagaattaatactgtgaaactaactgtccatactacccaaagtgatctacagattcaatgcaatatctatcgaaattccaatgtcaattttcacagaaataaattatccttaaatttatatggaagcacagaagacatcaaacagccgaaacaaccttgagcaaaaagaacaatgctggatgcatcaccctgtctgatttcaaaacattacaaaatgattgtaatcaaaatagtatggtactggcaccaaaaaaaaaaaaaccatacatctggacaggcatggtggttcacacttgtaatgccagcacttgggtaggctgaggcaggcagactgcttgagcccagagtctgaaaccagcctgggcaacatggtgaaaccccgtctctactaaaaatacgaaaataagccaggggtggtagtgaacacctgtagtcccaggtactcaagaggctgaggtgggtggacggctccagctcagaagacagaggttgcagaaagccaagatcacaccaccgcactccagcctgggctacaaataccaccctggctcaaaaaacaagaagacacatcgaccaatggaacaggaatgaactcacgcatttacactaagttgatttataacaaagatgccaagaaaacacaatgggtaaagaactgtctcctcaataaatggcactgaaaaaactgtatatccatatgcacaagaataaaatcatacccttgtctcacataacacaaaaaatcaattcaaaatagatgaaagtcttatgtttcggatgtcaaactataaaactactagaataaaacatagggagaaagttccatgtgggcaataactttttggatatgaccctgaaagcataggcaacaaaagcagtaatagacaaatgggatggctaaaccaccaagctccttacggcaaatgaaaatattaacaaagtaaagagacaacccacagaatgggagaaaatatttaatatccaaaatatatatggaacccaaataaacagcaagaaaacaacctgattaaaaaatgggcaaaggacctgaacagacatttctcaaaagaacacatacaaatggccaacaggtacatgagaaaatgttcagcatcactactcattagggaaatgaaaattaaaacaagtatatatcacgtaacacctggctattggctaacacctaacaaatggctactattaaaaagatgaaagataagtattgccaaggatacagaaaaaatgggagtcctgtacattgctgtgggggtgtcaattagtatagccattatggaaaatggtaaagaggttcctcaaaaaactaaaaatagaattaccatataatctagtaatcacacttctgggtatatatccaaaggaactgaaatcaatgtcaaaaggatatctgcatgcccatgcttactacagcattacttacaatagccagatatggaatcaacctaagtatccatcaatagatgaatggataaagaaaacatggtatatataaacaatggaatactattcagccttgaaaagcgggaggatggggagtggtggctcatgcctataatcccagcacttcgggaggccaaggctggaggactgcttgagcccagatattcaaaaccagcctgggcaacacagtaagactccatctctacataaaattttaaaaattagcctggtgtggtgagcacacaactgtagtcccagccacttggaggctgtggtgggaggattgcctgagcccaggaagttgagactgcagtgagttgtgagcatggcactgtactccagcctgggcaacagagtgacaccctttcaaagaaaaaaaaaaagagagagaaagagaaagaaaggaaggaaagaaaaaaaggaaagaaggaaggaaggaagggaaggagggagggacgaagggagagaaggaaggaaaaaagagggagggaaggggaggtagaaaaagagggggaggggaagggaagggaggcagggaggggaggggaaggggattaaggaagagtggggagagagagagagagagaagcgggagggacctgtcatctgcaacaactcagatgaatctagaggatatcatgctaagtgaaataatccaggcacagaaagacaaatacggcatgatctcacttatatgtagaatctaaaaaagttgaactaaaagaaccagtagtagagtgatggtaaccagacactcggagaaggtaaggcaggaagaaggaaatagtaagttgttggtcaaaggatatgaagattgagataggaggaataggttttgagatatactacatagtagggtgacctatattttaaaataacaatttggtgcaaaggatacgaaggttgagacaggaggaataggttttgagatacagtgcatagcagggtgacctatattttaaaataactattagtttggtgcaaaagtgattgtggttctgccattaaaagtaatggcaaaaaccgcaatcacttttgcaccaacttaagagtaaatttcaagtaacaaatgagagttaatcaaggtaatggatgttaatttacttgattcaatcattccactttgcattcatgaattgaaacatcacactgtactcataaatgtacaattaggatttgccaatcaaaaataacattcaaaaataataaatgtatcatgaatcattttagataaaatgtatatgttctgagaaaaatataacatgagaaaattggtacaagatgaaacagacagctgaatagaaaaaaatttggaagtggggagcaaatttatggaatacatattccaagaaaaaaaatctttgaattgaactggtaatgacttcattttctagaagaaaccccacagacccatgtaattttatgacagttacttcagacctacatggagtcaattcctgtcttaaactagctgttccagaaaataagaaaactgaaagatgcctcacacacgaggctagtgtaattttgtctccaaaactaggacattacaatattacaaaaattcatattgcttatgaacataaacaaaatattagctaactaaaacccaacagcatgtttaaaaaatgtcataatcaagtaatgtttattgaaagtaatcgagtaatgtttattgcaagtaatcaagtaatgcttactgccttctacagaagcttcttcttattgcattgttttgcttcatttttaaatacatatgaacataagttctttgttagttatatgctttagaaatatttttcccttttctgtcatttatctttttactcttggtatttttcatgaaaagttgtaaatttaagtatagtggtattaatcaatccttttcttttctttttttgagatgcagtttctctcttgtcgcccaggctggagtgcaatggtgcgatcttggctcactgcaacgtccacctcccaggttcaagcaattttgcctcagcctcccaagtagctgggactacaggtgcccaccaccacgcccagctaatttttgtatttttagtagagatggggtttcaccatgttggccaggctggtcccaaactcctgacctcagggatccacccaccttagcctcccaaagggctgggattacaggcatgagccaccgcacccggccccttttctttttatgtgtgttttttttttttgagacagggtctcactatgtcacccaggctggagtgcagtggcaggatcacagctcactacagcctcgacctcctgggctcaagcgatcctcccacctcagcctcctgagtagcaccaccaagtcctactaatttttgtattttttgtagagacagggctttgtcatgttcaagtcaggctggtctcgaactcctgggctcaagcaatcctcctgcctcaacctcccaaagtgctaggattataggcatgagccactgtgcctggccaatcaacccttttctataattagggctttccatttgttttttaaaagtctttccttaccccaaagcaatgaagaaattcctctacattaacttcttttattaatttgcttctcacgtgttaagtctataaattaactggagtagacatgaataaattaggtctttctttttttttttttttaaagtatgtctaattgttctagcacaattgttgaaagagacttccttcctcactaatttgtgatgcccctttgttataaataacctgtccatattaatcatgtatctgtatctgggttccctattctgatccattggtctatttgtctgtttctgtggtaatacagcactgacttaatttattagtgtgttacaaaaagtcttagtatcaagtaaagcaatccttcctcttcttcatgggtcctttggcttatcctgtcttttgcatattcatataaattaagatcagcttgtaaaatttactgtagaaatttttattagaattttcttgaacctacacatcaattgggaaagaatatctttaaaatactgaatcccctaaaatgtgagtattatactgctattatgtctgtgatccttaatctttccaaaaagttttataattttctctataaaagtcttacatttttgcacataatcctagtcacatattattttatattattggaaaatattctaaaaaataccatttaactctgttcctaatatataaaaatacatgtgatttttgcattttgattttgttatctagtaatcttgctaaaatcctattaattatacatattcatttagaacattttatatactgcaccattaaaattcattaaattcaggccggggacggtggctcacgcctgtaatcccagcactttgggaggccgagatgtgcagatcacgaggtcaggagatcgagaccatcctggctaacatggtgaaaccctgtctctactaaaaatacaaaaaaattagccgggtgtggtggcaggcgcctgtggtcccagctacttgggaggctgaggcaggagaatcgcgcgaacccgggaggcggagcctgcagtgagctgagatcgtgccactgcactccagcctgggcgacagagcaagactctgtctcaaaaaaaataaaataaaataaaattcattaaattcaatctgttcatcctattttaaggaaactgtgggacagagagataaaaatgaataaataaaggtcaaaaagtcggagcttggaataaacaccaagtctgtatttacagtatgctggctttctcagtgtacattcactctgtcctgtctaatgaaaataacagtggtagtggtagtatagcccaggataaataaataacaatggcattgcttattaatctacctcaaggttatttttccatgtggcatgagcatcaatctacctatattttttacatggatagccaattattgagtgacctattcttttccactgataggccatgattattataaatgaaattatcatatattcatgagtagcttttaactttcattctctgtacaagtattagatgaggactaacagtgacagtgtgctactcacaggtgacaaaaagataagtcagtcaggcatactgtgtccttaagatctgcagaagaaccaagcaagaaggttaagaactacaatgggttcccgaagtaggcctagaggatacagaggcacagaatactttcagaaggctctcaggcacctgctctaaactagcaaatattctgcattctgtacctctcaataccacatatgcattacaccatttctaatctctatataacacatagcaaaaagtaaagttcatggtagtatcaaactacaaaaatttaagcagaactttaaatgcttttcaatcaactagaattcattattcattaaaaatatattgggccgggcgcggtgactcacgcctgtactcccaacactttgggaggccaaggcgggtggatcacgaggtcaggagatcaaggccatcctggctaacacattgaaaccccgtctctactaaaaatacaaaaaattagccgggcgtggtggcgggcacctgtagtcccagctactcaggaggctgaggcagaagaatggcgtgaacccaggaggtggagcttgcagtgagccaagatcgcgccactgcattccagcctgggcaacagagcgagactccgcctcaaaaaaaaaaaaaaaaaagaaaaaagaaaaaaaaatttatacagcacctaatctccgtcaggaactattaagtgcaggacacagtgtggtgaacaaagcccaccaacaaagtgcgtgtcttcagagttcacatgacagtcaaatgaactgttggaaaataataagtgccacaaagaaaaataaagcaggttactatgtaaaatatggtgggagctgctgttttcttttccatcctactcctttattttgaaaatgttcaaacctcccaaaaaatattggaggaggaggagaggactacagtataacaaacaccagtgtgttctttcgttgattcacattgtatgttctttttcctaagctgactgagactaagctggatgtggcccttcagaggaggctagtattatcagcaaggtagcctctctgggaggtaagccaggagacaagcagagcaagcaccaaagctctcagacagaaaccccatcagcacatttaaaagagtgaggccaatgtggtgagagcacagtgagtgacaaatgacatgagagaggcagtcaggaacagatcacaccttgtagacatggtaagtacttgaaattatgaatataatttaaatataatagtcatgaaagagagtggagagtggggacctgattatcattattagaataatttttgcaactgtgctataaacaaattggactatggaaaggtaaagagaagcagaaagactggttaaaaggctactacaacttccaaaggataacagtgacttcaactaaaatgttaggcaagttaagacactaacaagttgtttgggttatcgagttgagctacaaggtatgagaaaagatagaaatcaaggattaactttcaaagtttctggactaaacaactgagtgaatactggcattatttattgaaatgaggaaatcgtagggagaagcagatttggggcagaggtggaggcagaatcaagcatggtactggacatgttaagggtgaggtgtctaatacacttccaaatagagacgtcaagcagacagttggacataaaagtctggagttcaggtaaagaagagtaacggaaatgaacacgtgagactcttaagggcacacacagaggttacagccattagaatgaatgagctttctttcccagggagtgaacagagacaaaaagtagacaagatatctgaggacttatccttaagaactccaaaattataaacatgtagagtctccacagcaactagcaaaagataaaatgaggagtgagatgtcccaaaagcaaaagaaagaaaatggttcaagaagatgagagaggtcaggtgcagtggttcatgcttgcacttccaccacttagggaggctgagacaggaggattgctttagcccaggagttccagaccaacctggataacataaagagacccagtctctaccaaaaaaaaagcttaaaaattagccaagtatggtggcacacacctgtagtcccagccacctgggaggctaaggtgggaggatcacctgagcctgggaggttgagcctgcagtgagctgtgatcacactactgcactctaccctgggcaacagagtaagaccttgcctcaaaaaataaaaaaaaaaagaaaggaaaggaagaaaagggaagaggaaaaggaagtagaagggaaacgaagggaggaaggagggagaagggatggaggggaaggagggagaaagggagggaaggagggcgggaaggaaggagggaaagaagggagggagacaggtaaggagggagggaaggaaggagatgggagtaccaaactgatggataatttcattattttattcatgtctttcaaataaggtctaaaaactcttaaaacttcaaagctgaattatacaatgatatattacaggcccagtgtagtggctcatgcctgtaatcccagcactttgggaagccgaggcaggtggatcatgagatcaggagatcgagaccatcctggccaacatggtgaaaccctgtctctactaaaaacacaaaaattagctgggcatggtggtgcatgcctataatcctagctactcaggagcctgaggcagaagactctcttgaaccagggaattggaggttgcagtgagctgagatggcaccactgcactccagcttggtgacagagcaagacgccatctcaaaaaaagggagggggggaggggtggtggggggggggagaaaaagaaagaaaaaaaataggttataatgtcctgtgtttccttttttaatgaatggggagaaggtaaggaacaaaactatcaacttaagtttacaggtaagtatcaaaaattaatcctcatgctaaatgctcacatttatgtcttctgccaggaacagcacattggtaatattctgtactggcctgaggtgactagagtaaaaccgtagtgtgctgccctgctctacaattgcctaagcccacagatgtaactcatcccaactaaacacagaggtatcagcttcaaatttagctactaaatcataaaatcccacccagattttcatcctaaactcatactccttgaattttctctatagtcatttcactgctttattcctgtcactaatatccaatccagctgcattcattctctaacctgattttggcttctacaccaacagagaccagggagtttgccgattcctcagacacagatcgctgaagagttggaattagctgtttgctgttatccacttctgcttcagcatcctcttctgcagattgttctttgatttctgcttaacagtaaacaagagaaaacaaagagtcatttttgtgtttattttaatcactggtgaatgtatctataaagcataggtcataatgtaaaaagaaacaacaaataacaatatttcactaacacaagaaaagttcatgcacgtaattagtggtattgtgcatctttattctctaccgcaaaatgattatcaaaataatgtgaagcatggtatacttttccttgtgcccaaattatagctgactcagagaagtttcatcctagtaataaatgttaagaatcttggccaggcatggtggctcatgcctgtaatccctgcactttgagaggccaaggcaagcaaatcccttgagctcaggagtttcagactggcctgggcaagatggtgaaacctcatctcaacaaaaaatgtaaaaattagccaggcaaggtggtgagtgcttataatgtcagctactcaggaggctgagatggaaggatatgccttgaacctgggagccagaggctgcagtgagctgggatcgtgccactgtactcaggcctaggtgacaaagccagaccctgtctcaaaaaaaaaaaaagaatcttatttttggccaggtgtagtggctcacacatgtaatcccagcaccttgggaggctgaggcaggcatattgcttgagcccagtagttcaagacagcctgggaaacatggtaacaccccatctctacaaaaaattagctaagcatagtggcacacacctgtagtcctagcgactctggtggctgaggtgggagaatcaatcaagccccggcagcggaggctacagtgagctgtgatggcaccactggactccagcctaagcaacacatctagatcctacctcaacaacaacaacaacaacaacaacaacaaaaagatttttttttttttttttttttttttgatggagtctcgctctgtccacccaggctggaatgcaatggcgcgatctcgactcactgccacctctgcctcccgggttcaagcaattctcctgcctcagcctcctgaatagctgggatgacaggcgcccaccaccatgcctggctaatttttgtatttttagtagagactgggtttcaccacgttggccaggccggtcttgaactcctgacctcaggtgatccacctgcctcggcctcccaaaatgctggaattacaggcatgagccactgtgcccggccaaaaaaaaatcttatttcaggattatagcaattggtctacagaacaaatgtatttcaaagtgactcattaaaaattgcttcacactttataaaatcatcattaaaagactcatcatgtatcttaattattacccattctaaaagcttaatatttgaaaaggacaaaccttcactttattgcctttttccattctccttgaatccaaccccaaacaccttaaatgttctttctcaggaggcagcctaacagctgagaggatttccacacaccactacccctaacatcattcttcttgtttaataaaaattatatgtccactctgtctgtcatgctctattactacaatgaagggacattacacctccccaccagtgctcatgatgcagttccatgctcttggctggctccttcttttctaatttgaaatttatttagacctttctgcatcactaaccccaaacaaacaaaaacatcttaaagtcctttcaagcgcctcttctctgtctttccttttaccaccaaattcatgagatggcatgactgaactctactaccttccccttcaactatacctttctaattgtatccagcctcctattataacaattattctcagctgggtatggtgatgcacacctgtaatcccagcactttgggaggccaaggtgggcggataacctgaggtccagagttcgagaccagcctgaccaacaacatggtgaaaccctgtctctactaaaaatataaaattagccgggcttggtggcacatgcctgtaatcccagctactcgggaggctgaggcaggagaattgcttaaacctgggagatggaagttgcagtgagccgagatcatgccattgcactccagcctgggcaacaggaatgaaactgcgtctcaaaacacacacacacacacacacacacacacacacacacacacaaattattctcgtcaacaccaccaatagaccaacggcaaaagaattaacaatccagttagcacccacaagctttcttcaaacatcctaaaagttcacttcacaccaggatcacttcctccttagtgaaatgatcttctatcttttataagcacagagatataatagtctaatatctatctcttcagctgatttcctttagacctctaaatataggtacagccctctatacatcctttatatactcctggggttgggtggttgtttttgtttttgagaaaaggactcactctgtcgcccatgctggagtgcagtagtatgatcattcgcattcttgggctcaagaatcctcccacctcagcctcccaagcagctgggaccacaggcacatgtcaccacattctttttcatttttttgtagagatgggggtctcactatgttgcccaggctagtctcaaactcctggcctcaaatcatcctcctgccttggcctcccaaagtgccaagaatacaggcatgagtcactactcccagcctataagctcctctttgaagaacttattatccacatttcaacaatttcctctggactttatgatttgtaagtcaacatctctagcactaactcctctcctgagttccacaccatattttaactatacactagacatacttagcagcttgaacactaaatttcacacaaaactttatctcttatcgctcagattagcacttcaatctgacttccctctttaaaaaaagaaaactatcttctacattcaaaatgaattttagaaaagtattttgaaaaacaatttgtataactattcttgggtagttagaaaaaactacaaataattgtaaatcctatcaaatcataaaactaatgataacatgaagcatcaaacagatggttttggttttcatacttaaaataacatgtttcttttcttttttaaaaaattgaaatagaaaagctgaccttaaattaagtgtttatacagtctatcaatcaaggtgtcctgtctatcccgagacaaaattgataaagtatctagaatcaaatctacaaatacgtaagcttgtattcaaaaggaataataaaatgaaaatttacatttctatgtgacaaatgacctcatgaacaaaatgaatgtgtcacagatgagagaaaataaatacaatttgaatccccccccaaaaaaaaaggtattcagatcaagaatagctaaataactccaaagatgaacaaggcacataaacctgtagaacgtagacaaaggggccgggtgcggtggctcacgcctgtaatcccagcactttgggaggccaaggcaggcagatcacctgaggtcaggagttcgagaccagcctcaacatggagaaaccccatctctactaaaaatacagaattagccgggcgaggtggtgcgtgcctgtaatcccagctattcagaaggctgaggcaggagaattgcttgaacttgggaggcggaggttgcggtgagccgagatcatgccattgcactcaagcctgggcaacaagagcaaaactccgtctcaaaaaaagaaagaaagaaagtagacaaaggacaaaatccatactcttcatcttctatgctttccaagttttagtaggacacataactgctcagctagagactttattccccaaccctctttgcagcaaaccatggcaagttctcaccgagagaatatgaccagaagcaactgcgcaacctcatcatctaaaaggaagtgagctgctcttcactaaattatagtcccctttcctacagactggaatggacatgacagcaacccagtcgcaatgctgccaatgaggcgcaatgctccaggtgatggcagagagacaagacagaagaaacctgggtcaacaaacaataatatggagcaaaagacaactcatcagcctatacctctccatcctcagaaatattacatgagagaagatcaatttgttttatttaagccactgctatattttggggtctctgttacagcagtttaacccatgccctaattaacacagaaaactggtattaaagagtgaagaattgccgtaacaaaatcttcaagtggcttgatcaggccgtgaaacactgataatggagtctgaaaatcaactgaccctttttaggctatattaaaatatttaatatagctatgacctacaacaatttggaatgtagactgtacctacagagcctgtagctctaggcaaagcatctggaatgacccaaagggtattctgtgttgcctctctctagtatttttacagccaaagatagaaaagaatacagttctgctagagagactctctctgcctgcctattatattcaaagtactataaaattatcacatatataaatacctgtatgaaagcatttcatttctactcagagagtcccagaatacattttgggatatacccattttataccattcttactactgggtaacaagaaaggggaagagaaaaataagtgacaaacttaaggaggaataagaatagtgccttcagaaacttaccaacaatgagccaaatggcccagggtcgcaaatcattacattaccctgaaaacacattttttcctggagccagatccatttgtctccactcccaagctgtgctctctccaatccagtatgacttgtctgcttccttttactatgctgctatctaccatatatgacctccagtcaaaaatttccttctcctagcgaagtatataacagtttcagctttttccttatttttatccccaaaaaagaaaatacatagcacttttattatttttaggggagttttattgcttacagctaagggaaaagaagcaggacaatgtctatctctccctcaaataagagccagaaggaaatagaaaagttaaacgttaatgttactggttggccagtaggtttgcaggtatacaaccttttgaaattatgtttcctgcatttcaaagagaaaaaaacagattcagactatagggtttttttgttttttttttgttttttaagaaataggatcggcaccagatctgatcccataaagcaggtaagaagacaggctttcagagttcatcctgttctcttttctcctctagctattattattactggctctgcccatgattctaacttggatctgctaaagaaacagtagggagcgatagttttggttttacttttggtttagattttgttgtttcagtcttgtgttctttaacaaataaagaggactctatgactgcttcctagatagcagtaattcctgccacaaaataggaacaaacaacaaaaaaggtatcactaaatatttgatacttcaggtaataacagaagctgtctttaactgtcactcttcatttggtagactatgttagatcttagtatctgtcaaagtcaaggcaggacaactgagtgtttatgtctctctctcttctcctaatcctagtcttcaaacaattgtcagagtttggcagcagaatgtgaaacagactgctctggataaaaatgatgtcaaccagggatccaaccagagatgtcatccagagatgctctggatgaaatggctacaaacccagtgatatctgaggaaatatgcctgatgccagtacttaattatctccagtttattattaaaaatgtactcttgaatactatcctatgctttgcctaaagaaagaagctagccattcaaccaataaaacagtccaggtttggcgactccaccactttgcagagtttttgcctttcatgaggtccaattagctcaaactgcctgcaagccaaactgtggaaattggagcagacatttaaaaaattacattgcatttttaaaaattcagtgtggtatttttcttgaatataaaatccctaatatatcttttcccttactttgaacctgacctaaaatacaggcaatgacacttggtcacaaaatgcaccaaagtcagaaaggtggggacaactgcaaccctgggataaggacaggcaaggcgatttcatctgtagccactatctacggataatctccatccactaggtggcacatgtacagtggtaaactatactaaggaacctaatcattgacctggcgtggtggctcaagcctgtaatcccagcactttgggaagcaggaggatcacttaagcccagaagttcaagaccagcctgggcaacatggcaaaagcaaaaaaaattcagccggccttggtggcacacaccagtagacccagctattcaggaggctgaggtggaagaatcacttgagcctgggaggcagaggttgcagctgcaccaagatcacaccactgcactccatcctgggtgacagagcaagtccctgtctcaacaacaacaataaaaaagagaacctaatcacatgtaagtagattcctaagagaacttgaagacaatgtgcacttcattaaatagcatcagctatgtgccaggcattatctctggggatgcaaagataaattagatctaaccctttcccttaaataagttcataacataccctcttttaaacctttacttttccacctccaatgactctaatttatcctacacaaattggttctaagacatgagaaagtttaatagcaaaaggtgtctgctgtgttagttaaaaccaaaggcttggaatccaatggttccgagtctgcattctagctctgccatctgctagcaatgtgacctttggcaagttacttaacttcatctcaattttactttgctcgtcatttaagacagacaataccacctagtataaaactgtctttatgatccaaaaataaaaaaaaaagaacgcatgaaaagcacttagctcaacgtcttaagtgtagtgatgtagctgctattctgatgacctctatctacattcacacactatagtctatggattcacttgtccacctcacttatacaacttgatttttttttttttttttaaagacagagtctcgctctgccgcccaggctggagtgcagtggcgcgatctcagctcactgaaagctctgcctcccaggttcacgccattctcctgcctcagcctcccaagtagctgggactacaggcgcccggcaccacacctggctaattttttgtatttttttagtagagacggggtttcactgtgttagccaggatggtcacgatctcctgacctcgtgatccgcttgcctcagcctcccaaagtgctgggattacaggcatgagccaccgtgcccagccctcacctactcaatttctaactcttgatgtcacatcatgaattattaaattgcattatgagaattaatgagaataaagaagacatttatttagccccctccgatctatgctccagagttaatatatcattaatttagaatggttatttaccaaacaaaattttgagtaacaagtacatactataatttctattcaaatggtagtcattacaaagatagtcaagatccctacgtttaatggatctagatgaaagactgaaaataaaaataggacacaataatgatgatgctggtaagcacatggcatgatgggagttaaggggaagaggtggggaatacagctcagaaaggcttcagaaaggtattagaagcccagctaaaactaaaaggataaatcaaagtgtgcctaatagttctctctcaagttttctcttttaaaaaaagaataacatctaacatattttcttcattcaaaagataaggaaactaaaatctgaaagttaattacaagctcaagatcacaaagctaataggaaacaaagctgggatacaaaatcgggttgtgtaactctaaagcctgatgtgctcttttcactacttccaccgcctggcagagcatcaaagtgtagcatgtaagttttataaatacatcaatattaaagagaaatgttaacagtcttactaggaccatgttactgagggatcacttactgaatataaacactatgagataactaaaaatactcttttttaagcactgctgaataaaattatgaagtggacagaacatttatctcacagccaagttcacagaaataaagcattttgattttgaacaattacaaaagtatttccctcaaaggttaaatacttctttgaaaggactgtgtgtagcctacaaatatactgaacaaacttaccaacactgatagcataacaggctatgtcaaaaatattttagaggtcaattttggactcccttatcaatacattagtatattctttcaaagcgtcctactttttcaatggatttttaaagtttactcactcaagggttataggattttagagggagaaattacttctttatttttactaacctctaatttttattcacttccaaaatttagaattctaagaaaatattaagaatgtaagcaacaagcacagtggtattggtggatacctaagtgtttgtcaccaacagaaatcacggatattttcttatcacatgcagttgttgcagatatcccaaaatatcattcaccctcatcactacttcaaaattacagtagttattaaattcactgctagattttataatttaagtgaattaaaaagatgttataagattacaagtttggcttatttttatttcaatgcaattgtttatctttgtaatcctattttggtgtatttttattttattcatttaaaaacattatttgaaaaagagtccatggattacatcatagtaccaaaggggactatggcactgaaaaagttaagaacccctgttctgtatgtgccattcacaggagaccacagccccaatttgactatatgctctatgaaaacaggcactgtatctgtttttataaaccagagctaccacaaaacctgaatgatgttcgatagttgcttaattaatattatataatataaagcaagcagataaatctcatatatagatacaaagatttataaaaagcacagagaaaaataatatatttaaaatgaactcatatttactaactatgcaagtaaacactgacattcattatcgactagttatccaaaaaatatgccttctccctctatgctttaatcaacttttttttttaagagatgggctcatgctctgtcacccaggctagagtacagtggcacaatcatagctcatcagaacctcaaactcctgggctgaaggtatcctcccacctcagcttccccactagccaggactacaaggcacatgcgatcacgcctggatttttttttttttttttttggtagagacagggattaactatgttgcccaggctggtctcgaactcctgggctccagttatcctcccacctcagcctcccaaagtgctagaattacaggcatgagccaccatcaccatgcccagcctaatcagctattaaatagaataactgacttcccttaactccagagaatggcaatacttttcatgcttgcttcctactaaaactacagaagaaaacatagctaagaaattgtgtaaccatgtccctcccttcttttgaaagaagtctgcctcctgacagttatgttttctggatatatctcattgaatctagtgtatccaatgtcatcaaaattgtactgtaaagctaaaacattagcactatattagaaaaagcaaattatttattaacactatctttattcactaaactacttaaaatattgacactgattaataatatgaatatagttgctgctttcacagaacaatgtaagcaactaaaagtaaatacacaaaaaaagcactaattttctctgagagttaacacttttacaggtgacttactctctttataattacccacagttccataaatttctacaaatatacattactgttataatatttaatgtgattttttaatgcaaattcaaaaagcttaagagtccaatacttgtcaaaagccaaaaaatatgcgggcattaatttaaatagtaattgtttaagcaggatagactgctaataaatgaaaaaaaatagtaactgttggaagtcaactgttctctaggtgttttatttagttgttatcagtatttcctttagttttcctacataacttttaaatgttaatggaattttttgcaattaataaaagaaactaaaataaaccaacaaattacaacatacatctttataacaattatttctaccaatattgatcttcttctgaaatttaactttatttaggccttaaaaacaaaaatgaaccaatgaaactgtcttggaccctctagaccagcccaggtgtcacctgaatagcaataaatgactctggtggatgccagcagagcagaactgcccagccaagcctgacctaaattcctaacccacaagatcatgaaatatgtttgctttttaagccactgtgttctgaaatgatttgttacgtggcaataagaagctgaatttttcattttaaacttcagtttgaaaattatgtatggcttatcaaagacatataggtgtctttgcttcaccatctcttcaactaaaccatcgaagcagtcagtatttcaaacactgacagtaactacaaaagaaaaaagctcagagggttttgctccagtccagaagtgacccatatgatttccacccacaattcactggacacagtcacatgggcctgtcaagcaggcttggagctgtgtaattccaccacatatccagaagggagagtgccagaactatttgacagacaacaccaatatctaccaccacagtatataattttaaataatatactaaagttagggaaaattttatccaaagaaaaacctgatacttcaaaaagagaagtgtcaattacaaactttcatatcaaaaaaagataagaaaggacaggtaaagttaaattgttaggccaattaatgtaataagaatccaggctttttctttgtgccaaatgtcaccataatctgttgtgaattagcagctagactcaaaatgtacaaacaataatttggggtgtccactttttaaaataataatatcactaaagtttctattcttgtaaataaaggcatatgtagggtttatacaaagctgtatacttaaaccatatgcaaataaccaaaaggcgctgaagtaaagtaacacgtgtatggctttggaactccaattccacctgtctcatcaagtgtactgacaaagcaaaagacccctatcttgtctatgtcaattaaatactaacatctgaaaaccaccactaaataagaaccaatagtcattacataagcaacagctaaaaattaacaaataattagaccagaagataatctaagattttgatacataactcaaggcagtatgatagacatcattagtggaaatccctcaaaggttagtcacaaatggtaatcttgatattaaatccgatagttttactattttaataagaattattatttatgagacatatttataataatggataggtattaacttagttattgttaacaattataatccattccactatagttagaactggcttaccaaattagaaaagggatataactatagttaatacatgtaaaaagctaaactgaaaaatcaacaactcttgctagaaccataaggtcaataaagtcacagggcaaacaggtaccctcagaactggaggaatagacatgaatcacaacttacctgagcagaaacccatgggtaaaaagctccatgggtacaaaaacctgaaccataattgacaaaacgttggaggttcagtgtggacgagtctggaagatacaaactacagagggacccagtcatcgtggggccccacggttttgtgttttacctctaggagctctaccagtttctcacagtgaacttcacagaaaaatatcttcttgctttcaacagcaggaggggaaaaggaaccatttctcttaacaaggcctgccttcaggagaaactatttaactagagcctaacctacgagaagagaaataaactccagccagttctagcctaagagaactatctaactttagcccattctaggccattctgccccacctaaaagcagtgaaagggcagggtggggaggaagagtaaaaaattcagacttccccctcctcctacaaggcccaccacattactacaggcctatttacagctgttgtctttacccagtgtactacacctggctatcgagaaaaaaaattacaaggtatactaaaaagcaaaaaacacagtatagagcaacatcagaactagacttggatgcaggaaggaatttgaaatgatcagatgaggaattgaaagcaactatgattaatatgctaacggttctaatggataaagtagacagcatgcaagaagacgtgggcaatgtaagcagagaactcgaaattctagagattaaaatgatagagatttttttaaaactaacagaaatgatgaatgcttttagtgggtctattagtagacctcacacagctgaggaaacaatctcattgcttgaagatatttcaaaagaaacttccaaacctgaaaagcaaagagaaaaagactgggaaaaaaaaaaaaaaaaagaacagaatgtttaatacagaaaactacaaaaaggtaacatgtaatggaaataccaaaaagagacaaaagagaggaagaagaagaaatattcctcaaattaatctcagaaaccaaatgacaaagaacatcaaaaaggataaatgcccaaacaaactacacctggtcacatcatattaaaaaccacagaatactgaaaaaacctaaaagaggtcagagggaaaaaaatacctaaggtaacaattacatcaactcagaaaccatgcaagcaagaaaagagggaatgaaatatgtaacatgttgagagaaagaaaacatcaacctagaattctgtaccctgcaaaattatccttcaaaagtgaaggctttctcaggcaaacaaaaatttaagaatttgttgtcagatgacctaccttgcaagaaatgttaaaagtccttcagagagaacaagaacggtacaggtcaaaaacttagacctatatcaagaaaggaagagcatctcagaaggggcaagtgaagataaaattttaaaaaaaaacttttttcttattaactgatctaatagataagtttgttcaaaataatatctgcaacaatgtattcaattatgattgcttatgtataaatacatatgcttatgtataactgaaatgactgacagcaacaatacaagggatgcgaggaaggaattaggattattttgttcttataaagtactcacattacaagtgaaaattacagtggtgccatcttatccatggggaatatattccaagaccccagcggatgcctgaaaccaaataacagcaaacccaatatatccagtatgctttttcaatcatactaagatggctactaagtgactaacaggcaggtagcatatacagtatggatgtgctggaccaagagatgattcacatctcaggctgaaaagcacaagatttcattatgctactgaaaacagcgtacaacttaaaatttatgaattgtttatttctggaatttcccatttagtattttcagaccacggttaactggaggtaaccaaaactgtgaaaagcaaaaccacagttaaagtgggacactactgcacagtgttattagaaagtagacttgggtttgttgtaaacatatattacaaactctaaggcaacaactcaaaaaaaaaaagagagaactgtgctaagaaagaagagaaaacagaatcatacaaattgctcaattaaaaccacaaaaggcaggctgggcatggtggctcacgcctgtaatcccagcactttgggaggccgaggcgggcagatcacaaggtcaggagatcgagaccatcctggctaacacagtgaaacaccgtctctactaaaaatattaaaaattagctgggcaggaaagcatgcgcctgtagtcccagctactcgggaggctgaggcaggagaatggcgtgaacccaggaggcggagcttgcaatgagccaagatgatgccactgcactccagcctgggcaacagagtgagactctgtctcaaaaaattataatacaataaaataaaatgaaaccacaaaaagcacaaaaagagtggaagacaaaaatatgaacaaagaacaaggacaataaatagaaaacagttaacagatatggtagatatccattccattatatcaacaatcactctaaagctgggcatggtggctcatcccagtaatcccaccactttaggaggctgaggccagcatttcaagaccagcctgggcaacacagcgagaacccgtccctccaaaaaaactattttttttttaattagccaggagtggtggtgtgcaccagtagtcccagctacttgggaggctgagcacaggtagtcccagctacttgcgaagctgaggtgcgaggatggcttgagcccaagagttcaaggttacagtgaaatatgatggcaccactgcactccaacctgggtgatacagtgagattctgtctctaaaaataaagaagaatcactttgagtaacaatggtctaaatataccaattaaaagacagaaattgttataataggttgtgtttgtttgtttgtttgttttgagacagagtcttgctctgtcgcccaggctggagtgcaatggcacgatctcagctcactgcaacctccacctcctggattcaagtgatttttgtgcctcagcctcctgagtagctgggacagtacccgccaccatgctcggttaatttttgtatttttaatagaggtggggtttcaccacgttggtcaggctggactcaaactcctgacctcaggcgatccacctgcctcagcctcctaaagtgctgtgattccaggtatgagccaccgcacatggcctagaatagattttttaaaaagaaaacccaagtacatattgtctacaaaaaaaccccactttaactataatataaagatacatacggataagaaataaatggatggagaaagatattccaggctaaaaataatcaaaagaaagcaggagtagctatattaatttcagacagctcagatgtcaaagttatcaggaataaagaaaggcattttataatgataaaggggttaattcccaagacatcagtgtgtctaaacagaacatcaaaatatgtgaagcaaaaaaatgatacaatctcaaggagtaagagatgaacccactattatcgttggaaagtttaacacccctctcagaaatagatctggcgtgcagaaaatcaacaaagacatagttgaatctgacaccgttaatcaactggaaataactgacatctaaagactacttcatcaacaatagcagaatacacatgcttctcatccacatgggacacttacaaggtagaccacattctgagccataaaacataccttaacagatttttaaaaatagaaatcatacaatgtctgctctcagatcacgtcagaattcaactagaattcggtaacagaaagatagcttaaaatcccaaaatactgagacattaaacaatacacttctaaataacacataggtcaaagaagaaatctcaagagaaattgaaaaatattttaaactaaatgaaaataaaaagaaaatttgtgagatgcagtgaaagcagtgcttagaggaaaagttatggcatttaacacatatacagttgacccttgaacaatgagagggttaggggctccaacccccccaccacacagtcaaaaatctgtgtaacttttgactccttgaaaacttaactactaatagcctactgttgacaggaagccttaccaataacataaacagtagattaacaaatatttctgtgttgtattatataccgtattcttacaataaagtaagctagagaaaagaaaatgttattaagaaaatcatggccaggcacagtggctcacacctgtaatcccagcactctgggaggccgaggcgggcggatcaggaggtcaggagataagagaccatcctggctaacacggtgaaaccccgtctctactaaagatacaaaaacttagctgggcgtggtggcatgtgcctataatcccagctcaggaggctgaggcaggagaatcgcttgaacccggaaggcagaggctgcagtgagccaagatcgtgccactgcactccagccagggagacaaggaaaaggaaaaggaaagaaaagaaaagaaaatcataaggaagagaaaatacatttacaagaccatactgtatttactgataccataagtttatgtcacctgtttacaagactgtctacctgaaatagtgggcaacctcagctacagacttccatctatggtacacatcaagcagttcaactttttcttgtatgtcatgactttgcttcttgtagggagcactttaagcatcattagtggcacttcatatgggtcccgtggtgttatgcacaatttatagcactgcactgaacatggtgaaagatacatgagaagcgccagatcactttttaccaagatacccaatttactggagagatgaactgctcaaagatgattggtatcccatggtgttttaatcagatatttgcaacacttgagttcactgcaataacaacaggaggtggccacataattattacagttgtacagtatgtactacagtaaattttattcagttattatttaatactacatctttacatttgtttacatttctctcaattgccaatggtaccacatacagtctttaagtgtgtgcttaagttttgataaattttaactttcagtaatagatttgtgtatattttatggtagtaaacaataaaacagacaagtatctacatatactttatgcattcatgcatacctttttcttaattttttaaatatttctaggctacacagtccatctacgcattttttcaaattgtcacgaatctccacgaaaaatttccaatatatttactgaaaaaaatccatttatcagtgcatgcacatggttcaaccccaagctattaaagggccaactgtttcagaaaggagggaaaatctacactcagtaatatcaaaaatgaaaaatgggacatcactacagatcccatggaatcttaaatattcaagaaatactattaacaactgtatgcccacaaatttgataacctagatgaaatggaccaattacttaaaagacacaatatgctcaagcttacacaagaagaaataatctgaatacgtctatacctattaaaacaaattgaatcaaaaattaataaacttcgaatattgaacacacccagtttggttcattgctgaattctaccaaacatttaaggaagaaattataccatttctctatactctctttcaggagataaagcatagggaaggccaggcatggtggctcacatctgtaatcctagcactttgggaggccgaggcaggtggatcacctgaggtcaggagttcgagatcagtctgaccaacatggtgaaaccccgtatcttctaaaaatacaaaaaaagtagccaggcatggtggcaggtgcctgtaatcccagctactgaggaggctgaggtaagagaatcgcctgaacccgggaggtggaggctgcagtgagccgagattgtgccattgtactccagcctgggcaacaaaagcaaaactctgtcttaaaaaaaaaaaaaaaaaaaaaaaaagaaagaaagaaagaaaaaaagcatagggaatacagacacctcaccaataaacataaacagatgggcagataagcatatgaacagatgttccacattatatgttatcagggaaatgaaaattaaaacaacagggcatcactacacacctattagaatggtcaaaatctggaacaccaacaccaccaaatgtcagtaagtacacagagcaacagaaacttttattcatttctagtgagaatgcaaaatggcacagccactttggaagacagcttggtggttccttacaaaactaaacatactcttgccatacaatccagaaatcatgctgcttggtatttatccaaatgagttgaaaacttacatccacaacaaaaattgcacatagatgttgacagaagctttcttaactgccaaaaccagggtgcaaatagaaattccatcagtaggcaaatggataaactctggtccatccaaacaatacaatattattcagcactaagaagaaatgcactatcaagacatgaaaagacacggaggagggctgggcgcggtgactcacgcctgtaatcccagcattttgggaggctgaggcgggtggatcacctgagatcaggagttcgagaccagcctgatcaacatggagaaaccccgtctctactaaaaatacaaaatagccaggtgtggtggtgcatgcctgtaataccagctactcgggaggctgagacgggagaatcacttgaaaccgggaggcggagactgcagtgggccaagatcacaccattgcactccagcctgggaatacagagcaagactccataaagaaagaaaagaaaagagaaaagaaaaaaacagaaaaggatgtggaggaaacataaatgcatattattaagtgaaagaagccagtctgaaaagactacatatcctatatgattcaaactatttgacactctggaaaaggcaaaactatggagacagtaaaaagaatagtggttgccataggttagcaaggagggagggagcaaggagggagggattaataggtggaacacctattaatttttagggcagtgactatgatactataatgacagatacctgtcattatacctttgtccaaacccatagaatgtaaaccaagagtgaacccttatgtgaactataaactgtggataatgtgtcaatgtaggcttaaaaaattgtgacaaatgtaccactctagtataggatgttgatactgaaaaaggctatgcacgtgtcggggaaggggatttatgggagatttcagtaccttcctcacaattttgctacaaacctaaaattgctctgaaaaataaaggctatttttggccaggtgcagtggttcatgcctataatcgcaacactttgggaagctgaggtgggcggatcacctgaggtcaggagttcaagaccagcctgaccaacatggaaaaccctgtctctactaaaaatacaaaatcagctgggcgtggtggcacatgcctgtagtcccagctactcgggaggctgaggcaggagaatcgcttgaacccaggaggcagaagttgcagtgagccgagattgcaccattgcactccagcttgggcaagaagagtgaaactctgtctcaaaaaaaataaataaataaaataaagtctatttttaaaaacttatgctagaagtaactgaatgtatcgatgtgaactcacatttgtaagtgtgtgtatagatctatgtaattacagtcctctcagaacagggatatgttctgaaatattcatcattaggcaattttgtcactgttacacaaacctagatggtatagcctactaaaaacctaggctatttggtacagcctagtactctaggctacaaacctgtacagcatgttactgtacgcaactataacacaacagtcaagtatttgtgtatctaaatatatgtaaacatagaaacaatggtaagaatacagtgtaaaaacacaaaaaatggtacacctacatagagcacttaccatgaatggtgcttgtgggactagaagttgctctgggtgaatcactgagtgaatgtaaaggcctcaaacattactatgcactaaagtaggctttataaacactgtacacttaggctacaccaaatttttaaaatattatttttctttgctcagtaataaattaaccttagcttactgtaacatttttactttataaactttttttaaactttttgacacttttgtaataacacagcttaaaacacacactgtacagctatacaaaaaaaatcttcctttctacccttattctgtaagttttttggttttagggtttttcttttttgtttctctgtttttgttttaaacttagcccaggcctacacgaagtcgggatcgtcactatcactgtctttccacctccacattttgccctgctggaaggtcttcagcgacaataacacacaaggagctgtcatttcgtatgataacaatgccttcttctgatatagctcctgaaggttctgcctgaggctgttttacagcttttttgcttaagaaaaggggtacactccaaaataatgataaaaagtatagtatagtaaatatataaaccagtaacacagtcacttattatcaagagttatgtactgtgcaagagtgtatgtagtgtacttttgtatagtacatgtaattgggagtacactgggtttgtttacaccagcatcaccacaaacatgtgagtaatgcactatgttgcgctgtgctatgacatcacgacagctatgacatcatgacagctatgacatattgaggtgacagaaatttctccgctccattataattttatgggactactgtcatatatgtgatctgctgtcattatgcagtgcatgactgtactagtatatgactaaagtggactcacataactaattctcaacagtaacaattgtaatatgcatccctttgttgtgggaagtcagggaccccaaactgagggaccggctgaagccatggtggaagaaataaattgtgaagatttcacagacatttattagagccccaaaataatacttttataatttcttacgcctgtctttactgtaatctctgaacataaattgtgaagatttcatgggcacttatcacttccccaatcaatacccttgtgatttcctatgcctgtctttactttaatctcttaatcccgtcattttcataagctgaggaggatgtatgtcgcctcaggaccctgtgatgattgcattaactgcacaaattgtttgcagagcatgtgtgtttgaactatatgaaatctgagcaccttgaaaaaagaacaggataacagcaatgttcagggaacaagagagacaaccttgaactctgaccgctggtgagccgggcagaacagagccacatttctcttctttcaaaagcaaatggaagaaatatcgctgaattctttttctcagcaaggaacatccctaagaaagcaaatgcatccctgagggtgggcctctaaaatggcccccttgggtgcggctgtcttttatggtcgagctgtagggatgaaataagtcccagtctcccgtagcgctcccaggcttattaggaagaggatatccccgcctaataaatttttggtcagaccagttgtctgctctcaaactgtctcctgataagatgttatcaattacaatgcgtgcccgaaacttcattaccaattttaatttcgccctggtcctgtggtcctgtgatctcgccctgccttcatttgccttgtgatattctattaccttgtgaagcacgtgatctctgtgacccacaccctattcatatactccctcccctttgaaaatcactaataaaaacttgctggttttgcggcctgtggggcatcacggaacctaccaacatgtgatgtctcccccggatgcccagctttaaaatttctctcctttgtactctgtccctctatttctcaaaccagccgaagcttagggaaaatagaaaagaacctacgtgaattatcgggggtgaattttgcccaatatctggctgaatttcccccgatatcccttgagcctaaatttttgtccctaatactattctccactaaaaaactagaagtccttagagaatagctgatttcataccttgtggcagggagaattttaaatgggcctgaaaaataaaacttttgccaaagagcacagagctctgaaaggttttgagatgttatttaaaaggactcagaagccagctgacaaggggctcccatgagccaaactatgacaacttgaacactaggagaaaaatgtttaattataactaactgaattataattagctaattatagttaatgaaaacaagtttgcaaagacctgattatgtgattctcaagaaaaaaaaagtttctcttctcttcaagtaactagcacttcactcaagttgattttattcatataaaaaaaatgcgcagagactggtaacagccaccaccaacaaaagatcaaattttctcagctgggtgtggtggctcatgcccgtaatcccaccactttgggatgccaaggcaggtggatcacgaggtcaggagttcaagaccagcctggcaaagatggtgaaacccagtctgcactaaaaatacaaaaaaattagccaggcatggtggcaggcacctataatcccagctactcgggaggctgaggcagagaattgcttgaacccgggaggcagaggttgcagtgagctgagataaagatgaaattttcttaacataaaatattaccaaatgaggtttcttattactttcccaatggctactcctagattactcattcccatccacccaccatggtaggagactcattagcattcttttcttttttctgagacaggatctcactctgttacccagactggtgaacagtggtgcgactgattacaggtcactgcaactggtgtctcccgggctcaagcgatcctcccacctcagcctcctgagtagctaggactacaggtgcacaccatcacacccaactaatttttgtatttttttgtagagacgggtttttgccatgttgcccaggctggtctccaactcctgagctcaagcaatccacccacctaggcctcccaaaggtctagggttataggtgtgagccaccacgcccagcgtaatacccttatattactacaaaacattaagtaagcatgtcaaggcacaggatttacaggaacaagagaaccttcaaataaaccctggggtcttgagacatacatatgttaaaaccttgcagcaaacttgaatgtgcttttaaatgaactagaaatttatggaacaaactctgtctggatttgcaggtttagtggttataacagttattctttctttcactgttctccttgccctatgttcactatgttccctaaaagaagtggacaatggactttccaaggacaaagacaaaacaaagactaatatacacttggctttattaactttagtaaagccaggttaaaaaaaatagttttctgctcctattaaaacatttatctaaactgtatttgccttgacctctcataggagacagcatgagaagacagtccattcgtggggcttactactctccagtaaggaaaaaaaaatgccaggaatttagttttgttgtaatgttgtaatgttccaagaatggtaggtagcttagaaaacataaagaaaattcaagaacacaatactgcttcacttagtgaatccaattcctcctatatccctagaagtattcttggcactggggataaataaggtaacaagacaaatcccctgacttcataaagcttacattctagtgtggaaagcatacaataagccaatatgaaattaaatgtcctatctgttacgtactaggagaaaaataaagcaggagaagacaaagtgacaagtgttactttttagacaagtttgtcaggaaaggtctctgggaaaactgtaactgagtagagacttgactgaagtaagggaataagctgtatgaatatctgagaaaaaatttttccaagcaaagaagacaaaaagtgcaaatgcctgagaaaggagtatgtttggtgggctcctggaaaagccaggaggccagtaaggatggagcccagtgaacaagggaacataagatacggttatacaagtagccaaagtcagatcaatggagcctgaaaacaatggtactgcatgaactttgaattttattctaaatatcactggagtctttggatggttgacagagggaagtaaaaggctctcactttgaatttggaaggatcactctggctactatgtgtgggacaagagtagaatggaatgaaaaggaaaaagaccagttaggaagctattgcagcagtccagtggaatggtagtgtgaagttctggaataatagcagtggaggggtcaaagtaattgaatccaggatatactgggtaggtaaagccctccagtgggctggatgtctaaaatgtgaaaatgtgaaatgtgaatgtctaaaatgtgaatgtataaaatgtaaaatgtgaaaatgtgaaatcaagaaagactccatctttttaagcctgaacaatatacagtggcaatataccagaggtggtaacactggaagagagggtttcaggataacaacaaaaatttccagagaggacacactaaatatgagatcctcttcagacatctaagaagagatgttaagaaacaagctgaaagatacaggttgtgttcaaagcaagaaagagctggtgacgtaattttagagtcattagcatttagataacataataatagcacaaaaatagataataagccattaaactgaataagaccacctaatacataagaagatgagcgaagagaatgagaaaaaaccagtgaaggagtaggaaaaaacaaaaaaacaaacaaacaaacaaaaaaaaaccaagacaatgcagtgacctgaaagtcaagttttaaaaaaaagtttcactcctgagagtggttagctgtgtgaaatgatcctgaaaggttaaggaggatgaagactaaaagctggtctgggcaatatgagatcattacattgacaagaataattttagtagaatgggaggaagaaagcttcattagagtgggttcatgagaaaatggtgaaaaataagtagtaatcataggtataaataactcaaggatttttgctatgatggagcaaagaagctgtatagtacctaaaaggggatgttggatcaagagaggctatttgtgttgaaagggggtgattctgcagcaccccccttatgctaatgaaatcaatgagatggaaaagttattgatgcagaaaagcaaggacaactgcagaaccaaagtccgtaatacatgagaggggacacaatggaagacacaagcagaggagctggctttatccgcagtctttatcccattttaccaggacagaaacaacatacgggtagggatgcaagcaagaaaatagatttgatggtagatgaatatggaacttcttttctaattgttctctattttttattttttcactgaaataagcaagatcatcactaaagaatcaaaaatgagaaggggtgttggaagtttcaggagaaaagaaaaggtggtgaaataatcatcttcaataatcaaagggccgggcatagtggctcacgcctgtaatcctagcattttgggaggccaaggtgggcggatcacgtgagatcaggagttcgaggccagcctggcaaacactgggagaaccctgtgtctactaaaaatacaaaaattagccgggcgtggtggcgggtggctgtaatcccagctactcagaaggctgagacaggagaatcacttgaacctgggaggcggaggttgcagtgagccaagatcacgccactgcactccagcctggggaacaaaggacgaaactctgtctcaaaaaaacaaaattaaaaaaaataataatcaggcacggcgcggtgactcacgcctgtaatctcagcactttgggagggcaaggcaggtggatcacgaggtcaggagttcaagaccagcctggccaatatggtgaaaccccatctctactaaaaaatacaaaaattagcgaggcgtggtggcatccacctatagtcccagaccaggagggagactgaggcaggagaatcactggaacccgggagacagagattgcagtgagctgagatcgcaccactgcactccagcctgggagacaagagtgagactccaactcaaaaagaataataataataataataataataataataataatagcaataataataattagagccagacacggtggctcacacctgtaatcccagcactttgggaggtgggtggatcacctgaggtcaggagttcgagaccagcctcgtcaacatggcaaaaccctgtctctactaaaaatacgagttatccaggcatggtggcgcatgtctataatcccagctacttgggaggctgaggcagggagaactgcatgagcccggcgggtggaggttgcagtgagccgagatcacaccactgtagtccagcctgggagagagagcaagactctgtctcaaaaataacaacaataggccaggcacagtggctcacgcctgtaatcccagcactttgggaggctgaggtgagcggattatgaggtcaggagattgagaccatcctggctaacacggtgaaaccccgtctctactaaagatacaaaaaattagctgggtgtggtggcgggcgcctgtagtctcagctattaaggaggctgacgcaggagaatggcatgaacctgtgaatccaggaggcagagcttgcagtgagctgagatcacgccactgcactccagcccaggcaacagagcaagactcttgtcttaaaaacaaacaaacaaacaaacaaaaacactaaagcttcaaaaagacttttcagtagtaaaagtaacaatatatagtacagaaaaaaaaaccatatgaaaaagaattaacagtttaaagtaatacagtaattcatgaatgtgcacaaaagggtgaaatttagtattctgagcttccaagagtaatactctaactagaccttattggaaagaaactatagattatttgaaggctttccaagaattatacctatataatagcaacacatctgacaactgtaaggatttctggaaaaatgtattttaaaatctataacaatttttaatttttctcatctcttaactgcatgatattctgtaagcatcaagatgatattcaacttcagagaaaaagcctatcactgtgtctaaactttatctaacaactattgaaaactttaccaatgagagactatctcctacaggtatcctctcaatacaatatgaatcctagtccctttgataacttaccactgacctgaaaattttggaaactgctttgggcaaccaactctagctaccttttgcagatgcacaacatacagcagcttatttaagggcacctaaaagtccaacagaccagaaactatttggtctagtttggcctagcctttcacaatattaattccataacgaaacatactacttttttcagaacacatattaacaaaataagctttaaacaaacactagatggttcataggccagaatatactatgagcgattatactaacagcctggattactgtttctcccagtctttatttccttgataaaacatttatcttcagatataaaataattatactaaaccagggcttagggaaaaaagagagatagagggctcagttttttcactttgtcattagttatcaaaacaaggcagatgggaaacttagagttcagtataaaaacaaatgcttaacacagaatattgttatacaaatgctacatgcagtgtacaaacatatgcaaagcatcattatacattcttataaattcttgagttctgatacctgtttccacaatcgtttctgtttctgttgtctccagcccatccatgctgtcctcatcttccactgcagttttccccctacttcgaggtctacagaaaaaaaaaaaaataataagtacatagagttaaatgttaaattttaaggcttagacttatattcaacataaggcacaatttgaaggtatacaaaataagtaattagggcatttttccagcattttaccatatcaagtagaaaatatcagagtttacagtcattttctcccttaaatccagcacttccttatactctaaatgtgaggacagacccacatgaatataattgtgtcctcataattcacttaagtattcctcactctggttttgccccttttttaggtaaccttctgaagtctccctctgtctacagtagtggcttttaactacataatgggttcttcacaaagttcacataccaggtttaacttctatatttaataaagttgatgtgaaatgaccagatatatgtatttttaaaagctttgtaaaaggtgcttttggtgactgtgatgcagatgactaaaaaacaaaattttaaaaattaagcacgattataatcatgtccaccttacaagcataataaaatttaatttataaacacttcaggaaagtaaaataaaggtaagagtcacagcaaggtgaaattcctgacagaaagcaattgaaaaaaaaaaaaaaaactaatgcctttaaattctttgaattgtactaaatacggtatagaaatgagtaaaagaaaaattaataacacataagagcaacaagatattacacataaaaacttggaaactgacaaagcagtactcagataatgtcagtgttttaaattatttcgcagtattttaaactctttaaaagaaaaaggctgggtaaggtggctcacacctgtaaccccagcactttggagggtcgagttagatggatcatttgagtgcaagagttcaagaccagcctggccatcatggcgaaaccccatctctaccaaaaaaaaaattcaaaaattaggcaaacatggtggcgtgccagtaattccagctaaagaaaaaaaacaaagaagggagggagggaggaaatagaaagaaaaaatacaaatcaactcagtatttaattgaaaaacataaaacatttaaaaagtgaaaaacagctggctgtggtggctcacatctgtaatcccagcactttgggaggctgaggcagatatatcacctgaggtcaggaggtcacgaacagcctggccaacatggtgaaactccgtctctactaaaaatacaaaaattagccaggtgttgtggcgtgtgcctgtaatcccagctacttgggaggctgaggcacaagaatcgcttgaacctgacagatggaggttgcagtgagctgatatcatgccactgcactccagcctgggcgacagagtgagactgtctcaaacacacaaacaaaaaaaaggggggtggggggggggggacaatatgaaataaaagaataatatgaaaaaagaataaaacaaagaactatgttttaaacaataagaaatccatttaagtcttgttctcataaaaaagttaaccaacctaggccaggcacagtaactcacgcctgtaatcctagtactttgggaggccgaggtgggtggatcacctgaggtcaggagttcaagaccagcctggcctacgtggcgaaacctcgtctctactaaaaatacaaaaattagctggacgtgttgatgcacatctgtaatcccagctactcaggaggctgaggcaggagaatcgcttgaacccagtgggcaggaggtgcagtgagccgagatcacaccattgcactccagcctgggcaacaagagtgaaactctgtctcaaaaaaaaaaagttaaccaacctaaaccatgaaggagctataacataataatatattaaaaattaaggtgaccagccgggcgtagtggctcacacctgtaatcccagcactctgagaggccgaggcaggcagatcacctgaggtagggagttcgagaccagcctgaccaacatggagaaaccccgtcactactaaaaaaaatacaaaaacaaaaagaaaaattagctgggcatggtggcacatgcctgtaatcccagctactcgagaggctaaggcaggagaattgcttgaacctgggaggcagaagttgcggtgagccgagattgcaccactgcactccagcctgggcaacaagggcgaaattctatctcaaaaagaaaaaaaaattgaagtaatcaaagcctaaatggttttataattaaactactaaaaactatcaaaaagtcggtcttaaccaaaaataaaaaaaaggaagtacctgactcagaattccaacaaacattgtcaaaaactatgaatgaaaataaaaactgagaacaatcctattgaatataatcagaatgccaggatgattcaacattagaaatttgttaatgttacataacaagtcaagcagtcaaaatagcatcacttcaaacttcacagggggaaaggggaaagaaggcagaactaaataaaaagactacaaaacctgaaagatgaaaaagggtgaattagggagaaaacactctaaggtggatcttattgttcatggacaaaaagaaagaacatctttagaatttattaagtagttgtttttaggctgggcacggtggctcacgcctgtaatcccagcactttgggaggctgaggtgggtggatcacgaggtcaggagatcgagaccatcctggctaacacggtgaaaccccgtctctactaaaaatatacaaaaaaattagccgggcgtggtagtgggcgcctgtagtcccagctactcgggaggctgaggcaggagaatggcgtgaacccgggaggcagaggttgcggtgagctgagatcacaccattgcactccagcctgggcaacaagagagaaactccgtctcaaaaaaaaagaatttattaagtagttgtttttaaatttgatagaaaacattaaaataaagtggaaagaagggataagaaaatttgatcaatccaacagcaggcagaaaaggaatgaaaacaaatggtacatagaaaataacataaaaagataaatataaatatgaattttcacagtaaacataaatggcttaaactgtcataatgataaaaaaattaatttacttggataacataagagaacttcagattacataaagcaaacatttacagaacaaagagaaattggtaactaatcattagagagatattaacatcccactgtcggaaactgatagatgaaacattatagtttgaagcattttaaacaagtatttggacaacacattgagcaagcattactagattactctatcaatcttcctttgtgtctgactctgttcaaacacagtggatacagaaataaataaaacaaaatccctcctgtcacaaaactacattctagtgagaagagacaacagtaaacaagtattacacatacaacatccaacaaaagaaagcaaagaaaaagggactagctattttaaataacagatttataaaataaatgttttaaaataaaattttgtaaggagccactttagcacagaactgaagatgaagcaaaccatacagatatctgggagaaaagcattgcagtagaagtaacagcaaatgcaaaattcttgagatgagagcaagtgaggggggttagagggacaagaaggatatacggtggctggggcagagtcagcggtagggggtaagaaggcatgaggtctaagaatttttttttaataggatcactttttgtttagaaacctgtagaccaatacaagaactggggactgggagactagaaatcctcgaaacaatcccaacatggctgcttcaaagaaaatagagaatgacaaaataattcacatgccattatggaggtagagtttacttttcatctttcttttgtgatttttcataatcataaacatccacttttaaagaaattggaaaccgtatggtttagctgactttttaacttaatctctcagacccatgttttgctctactttgagttttttctccactatcttgaccatcactgtctatgctgttgtttgttttggcacaactggctttatttcaagctcgttctgtctagtttataatctctatcaacatatcagttatctgcattgccctacttactccttaaaaaataattttgattttaatttttgcttttcaaatttttcttctgatttctattcttggttttggcactaggaagacatgctttttacgttgatcaattcatcagaattcctttccttctgggcaatggaccaacttattgacatcatgtcattttcgaattcttttatttcatcggtgtccttattgctgctcattggcttctgccatgtgacttttctgactaatcaaacactatattctgaatgcaaagataatggtcatactcttcaaaaccctatcagttgccaactttcatatttaaacagcaaaatagatacatgttttatatttccatattgagtcagatatttccagtttcagtttttaaggaaagtttgaagtctaattacaaatgacaacatgaagattatttattttaacccttctttgggttttcttcgttcccctctttttcctgtctcttaaccctttcatttcagtgttcttcacttcactttattaccaagaaatgtgaagtaaaagaatacaactaactttatttgagaaaattttctaccaaaactttatgttccatattaatctcagaatctgaaaccaacttgagttcctaaagtaacataggagacttctacataaagccacatgggagtaagacaggtcaaaattaccctccagcccaaacaactaggaaaccagacaaatataagaaacaaccttattataagacactgggcaacaggtatggcgaagggaacaaagggaaagaaacagggtgacccctaccatggcacaggctttctgcttggcattaatttagaaactaccacacagagataggaacccaaaatgagagctgaaatgagaagacagaaatcataggttcaggtggctcaagaagactagaatttgtgggacagactacccaagagaagagaggtattcagagaaagagctccagaaatctgcagagggatacccttgagtttcaactgaataccaatctgcacatgtgtgatgtgaaatcccagaagactgaacaagaacaacttccagggagagagcaattacagaagaacaattcccagagctcacagaaagctgcgaatcaactgtattgtctctagccaactgtattgtctttagccagagtggcaagacctcaatgactatgtaacacattcagcagagaccagagtgagacacacctttaggagcagggctaaatgagccacagaacaaatgctattctagaccatccctaaaagagctgacaaataagtctcaacttatcctgagagtgactctgtatgaaaaaaataaataagtctcaactgaacaataatgattcccaacttaactactgggcataatccaataatccagctattataagtatgcctcatatgcgcaagaatgtaaagaaaacatgaatatgagagaaacagaagatattaaaaataacatggaactcaaaggtaacatcaaaagataacatcaaatgtaaatttcaggccgggtgtggtggctcacgcctctaatcccagcactttgggaggctgaggcgggcagatcacaaggtcaggagatcgagaccatcctggctaacatggtgaaaccccatctctactaaaaatacaaaaaattagccgggcgcgtggtggcaggtgcctgtagtcctagctatttgggaggctgaggcaggagaatggtgtgaacccaggaggtggagactgcagtgagccgagattacaccactgcactccagcctgggtgacagagcgagactccgtctccaaaaaaaaaaagaaaagaaaaaaagaaaaaaatgcaaatttcacattgaaaagttaacatgtgattagaaatgacaaaagaagatcattatccctaaagacataacaaaaaaaaatctattcaaaataaagaacagtatgaaaaatgacaacacagctacagtgccctgtggaataatagcaacctacctaactaatatgtgtgaggttggggttaaagggatagggacaaaaaaattgtttagtgaaataattagctgtaaattttaaaagctgtattattataagcccacagatccaagcacaacaaaatctgaaacagacagacacacacacacacacacacacacacacacacacacgtaccagtaaggtactttatagtcaaattgctgaaaaagattaataaagagaaaatattaaaagcagcaaaagaaaatacacattgcttaaagggggaataaagtaaaaatgactgcaggcttcttgtctgaaactatgtaagccagaagacagtaaaaaacatatttaaagtactaaggagaaaattaaaggaaaaacccttctaaacactgaacaaaacatgcagcaaaaaaaagtatccttcaaaagcaacagtaggctgggtgcagtggctcacgcctataatcccagcactttgggaagccgaggcaggcggatcacctgaggtcgagttcgagaccagcctggccaagatggtgaaaccctgtctctgctaaaaatacaaaaatcagccaggaatggtagcaggcgcctgtaatcccagctactctggaggctgaggcagaattgctccaactagggaggtggaggttgcagtgagcagaaatcgcaccgctgcactccagcctgggcggcagagtgagaccctgtctcaaacaaacaaacaaacaaacaaacagttaactaaaaacttcctccttttttcttttcttcttttgagatggagtctcgctatattgctcaggcaggtcttgaattcctggtctcaagcgatcctcccaccttggcttcccatagggctgggattacaggcattagcctcccggcccagtgttttgttttgaagtgtgctttgtctgatattaacatagccactccagcttaatttgattagtgttggcatgttttatctttctctttatgtcattttatttcaattgtctttcaggtagacagaatataattaggtctaaaatagattctattagtggggcatagtggcatgtgcctgtagtcctgggtactcaggaggatgaggtgggacgaacacctgacaaaaacaacccaactcaaaaatgagcaaagaacttccacagacattttccaaagaagttatacaaatgaccaaaaaaacatgaaaagatgctcacgatgactattagaaaaatgaaaaatcaaaactaagatataccacctcacacccattaggatggctactgtgaaaaataaaaaaaagaataacaaatgttggcaaggacgtggagaaactgaaacactagtgcacaggtgtagggaacataaaatgatatgggccctggaaaacagtacggcagtttctcaagcagttaaaaatagaattgccatatgatccacaaattccacctctgggtatacaccaaaaagaatcagaagcagagtctccaaagagatatttatacacccatgttcacagcagcattattcacaataaataaaacataattaacagttaagtaaaatgtggtacagacataccacattggcagtatgtctatggtggaatactatgcagccttaaaaaggaaggaatttctgacatatgcgatactacaacataaatgaaccttgacaacaatctcctaagtgaattaaaccagtcacaaagaaaaaaaaatagtggatgattccacttatataaggtactaagagtagctaaaatcagagacggaaagtggaacggtggttgccagaggctgagagaagggagaaactgggagttattgtttaatggctataaagtatgagtttaacaagattttttaaaaagctatgaaaatggatagtgtctacattatgaatgtatctcacatcactaaaatgtacacttaaaaatagttaaggggttgggtggccacagacggccgggcgggatgtaaccagccgctgagctgcagcccttccgtgtccgcaggcttcggcccggccgccgccgcccatcagctatggaggagctttacaacttcccggcctgcagagccgggcgcagcaagggccagacgcggcgcgagctggcgctgcgagccaacgggccggcgcctggcgggcacgatcgcaaggtcgcgcagaagctcctcaatggccagcgccagttgcagccccggccgcacccttgcctcacctgagcctgggctcttgctcttgcggaatccacaggtctttcttgaagaaatctgtagtcagaactctgtgctgcatttttatccagagaaggaacaggaagagaagagtgtggtctcctagaaatctagcactggagaaacgaggaaaattcttccaaggatggtctcccactcagagctgaggaagcttttctactcagcagatgcagtgtgttttgatgttgacagcacggtcatcagagaagaaggaaccaacattcaaagcagctgccaactattccaagtttcccagctggaggagccctgacctgcaccttcgcagaagccctgaagcagacaccccagggagcacctaccaggggcacccccggctggcaccagcatacaaagtgagacagggtctcgccttatttcgcaggctggtctggaactcctgagctcaaacaatctacccacctcggcctcccaaagttctgggattacaggtgtgagccaccttacccagagaggcgaacctggattgggaaagtcgacattaatcaactcattattccttacagatttgtatgctccagagtatccaggtccttctcatagaattaaaaagactatacaggtggacaatccaaagttttaatcaaagaaggtggtgttcagttgctgctcacaatagctgacaccccaggatttggagatgtagtggataatagtaattgctggcagcctcttatcgattacattgatagtaaatctgaggactacctaaatgcagaatcacgagtgaacagacgtcagatgcctaatagcagggtgcagtgttgtttatacttcattgctccttcaggacatgaacttaaaccattggatattgagtttatgaagcgttcgcatgaaaaagtgattatcatccaacttattgccaaagcagacacacttataccagaggaatgccaacagtttaaaaaacagataatgaaagaaatccaagaacataaaattaagatatatgattttccagaaatagatgatgaagaagaaaataaacttgctaaaaaggtaaaggactgtttacctcttgctgtggtaagctagtaatactatcattgaagttaatggcaaaagggtcaaaggaaggcagtatccttggggtgctgctgaagttgaaaatggtgaacattgtgattttacaattctaagaaatatgctgataaaaacacacactcaggacttgaaagatgttactaataatgtccactatgagaactacagaagcagaaaactggcagctgtgacttataatggagttgataacaacaagaataaagggcagctgactaagagccctctggcacaaatggaagaagaaagaagggagtatgcagctaaaatgaagaagatagagatggagatggagcaggtgttagagatgaaggtcaaataaaaagttcaaaaactaaaggactctgaagctgagctccagtggcgccgtgagctaatgaaaaagaatttggaagcacagcacaaagaattagaggaaaaacgtcgtcagtttgaggatgagaaggcaaactgggaagctcaacaacatattttagaacagaactcttcgagaaccttggaaaagaacaagaagaaagggaagatcttttaaactctctattgaccaccagttacgtattagttgccaatatgccagcttggacatcagtgtttgttggatccgtttgaccaatatgcaccagtttcatccataatgatggatttaacagcgtgacaaaaattattttttcttgtttttcttgatggagattaagatgccttgaattgtctagggtgttgtgtacttagaaagtaacagctctaagtacctttcctacattttctttttcttttttttattaaacagatatcttcagtttaatacaggagaacattttactgttgtacaatcatgttctcgtggtttgattgtttacagcctattccaaaataaaaggactgtggaaggttaaaaaaaaaaaatagttaagggccaggagcagtggctcacacctgtaatcccagcactttggaaggccaaggcaggcagatcacttgaggtcaggagttcgagaccagcctggccaacatggcaaaatcctgtctccactaaaaatacaaaagttggccgggcatggtggcacgtgcctgtaatcccagttacttgggaggctgaggcaggagaatcacttgaacctgggaagcagagactgcagtgaaccaagatcacgccaccacactccagcctgggcaacagagtgaggccctgtctcaaaaaaaaacaaaaacaaaaaaaaaaacaagatggcaaattatattttgtgtatattctaccacaactttttaaaaactcaaatcaaaatctgactgtttgtaaagatcaataaaattgacaagattccagcaaaactaacacacacaaaaaaatgactactatggtttgaatatcatttgtcctcaccaaatctcatgttgaagcttggtctgcaatgtagcagtgttgagaggtggtacctttaagaggtgattaggttgttaagagggattaatgtcgttctgaaaggagttctcactcttggagaagtgaacccacaagagtaggttgttataaagtgaggatgcctctcatgtttggcctctctttgcaaacatgtgcttccccttgcacttctctgccatgttatgacacagcacaaagccctcaccacatgcggcaacccatcttagatttctcagcctccagaaccataaaccaaataaatctttttcctttataaactaccaactctcgggtattttgctatagcaatagaaaatgaactaaaacaggaatgaaaggggatttcactatagactccacagacattaaaatgacaataaggttgggtgcggtggctcatgcctgtaatcccagcgggcagatcatgaggtcaggagatcgagaccatcctggctaacacggtgaaaccccgtctctactaaaaatacaaaaaaattagctgggcgtggtagtgggcacctgtagtctcagctactcaggaggctgaggcaggagaatggcgtgaaccctggaggcagagcttgcagtgagccgagatcacacaactgcactccagcctggacaacggagggagactccgtctcaaaaaaaaaaaaagaagacaataaaagagcagtatgaacaactccacacacataagtttgatatctttaaatgaaatggaccaattcataggaaatgacaaactaccaaaactcacccaagatgaaatatgtaacctgaacagctctgtaactattaaagaaattgaatttatagtatgaaattttctgaaataacaatctccaggcccaggtgctttcactaactaatttctaaccaacactttaagatgatgtaacaccaactctacagaatcccttccagaaaaaggagggaacaacatttctccactcatttaatgaggtcagcattatcctaaagccaaaatcaggcaaagacagtacaaagaagcaaaactaaagaccaatttcctaagtgaacataaacacaaaaatcatcaagaatatattagcaaatcaaactcaggaacataagaagagtaatataccacaccatgtagggtttatcccaggaatgctacacttgttcaatattcaaaaaatcaatcaatgtaatctaccatgttagaagtctaaatcactggtcagcaaactacggtccagaggccaaatccagtcctgtacttggtctttgtaataattttatcggaacatagccatgtatatttgtttacatacagtctacatctgctttcatgctacaatagcagatatcagcagttacaacagacagcatattgccagcaaagcctaaaatatttactatgtgaccccttacagaaaaaaatgtgggaggtcaccaccattagacctgccttacaagaaatgctaaagaaagttcttcaaattgaaacaaaagaactctaaaaacataaaaacatattaaagaataaaactcactataaagataacaatatattcaaattcagaatactccaatactgtaatggtggtacctaaatcagatttaagtctagtataaatgtaaagagacaaaagtattaaatattaactatacatacaacaatttggtaatggatacatgatatataaaagatatacattatgaaatcaataatacaaaatgtgaaaggagacgttaaatgtaaagttgtggtatactgttgaggttgtcagcttaaaatagactattaacactataagatgttttatgtaagcttcatggtaaccacaaaaaaaaggctgtagtagatacataaaccagaaaagaaccaacgcatatcactatcaaaaaaatcatcaaatcacaaaggaagacagcaagagaggaagactgaaacaaacaaacttacaagagtcagaaaaattgacaaaatggcgatagcatctccttgcctatcaataattattttaaatggaaataaatttaatactccagaagacacagattggctgagtgattttttttttaattttttcatttcattttattttttttgagatggagtctcgctctgtcacccaggctggagtgcagtggcatgatctcagctcactggaaaccccacctcccaggttcaagcagttctcccacctcagccacctgagtagctaggattacagacacatgccaccacacctggctaatttttgtatttttagtagacatggaatttcaccatattggccatgctggtctcgaattcctgacctcaggtgatccacctgccttggcctccctaagtgctggtattacaggtgtgagccaccgtgcctggccgagtggatttttaaaaacaagatccaatgatatgctgcctacaagatacatgaaacagaaaatcaaaagcatatcactaccaaaaaatcgtcaaatcacaaaggaagacggctagagaggaagactggaacaaagaaactacaagagtcagaaaaactgacaaaatggcagtagtaactccttacctatcaataattattttaaatgaaaagaattaagctctccaataagacacagattgaatggatttttgattgtttaagacggagtctcactctgtcgcccagactggactgcgatggtgtgatctcagctcaccgcaacctccacctcctgggttcaagcgattcacctgcctcagcctcctgagtaactgggattacaggcgcccaccaccacacccagctaatttttgtatttttagtaaagatggggtttcaccatgttggtcaggctggtctcaaactcctgacctcaggtgatctacccacctcagcctcccaaagtgctaggaatacaagcgtgagccactgcacccagccaagcggatttttaaaaacaagatccacctatatgctgcctacaagagactctctttagctttaaaggactgaggctgaaagtgaagagatggaaaaagatattccacacacatgttaaccaaagagagcagaggatccttacataaaataaaatagactttgagtcaaaaagtgttaaaagagatcagaggtcaattcatcaggagaatgtaacatttataaatatatatacatgccccaatttggagcacctaaatatataaagcactatcaatagaactaaagggggaaatagcaataccgtaatagtggggaacttaaataccccactttcgacaacggataaataatccagacaaaaattaataaggaaacacagacttgaacattacagactaaatggacctaacagacacatacagaacattctagccaacagcagctgaatatacattcttcttaagcagacacagaatattctccaggatagatcatatgttaggccacaaaacaagttttaacaaattcaagaagaatgaaatcatttcaagtatctttctaacaacaattgtatgaaactagaaatcaatgacataggaagaaagctagaaaattcataaagaaatcaaaagggaaaatctgttaatatggttgtcatatttacaaatcaaggaaaaatgatcatctcaacaaatgcagaaaaaaaacagatataaatgcagtaagacttctatgtccacgggttccgcatctgtaaatccaaatgactatggatcaaaaaaatattatttgtttattactgtctctttagctgtatactccatgaagactagaaatttgttctattcactgctgcacccccaacacctaacagcaccagatgaaacataagcactcaatatatgttttgttgaaagagtagatggttctataactcaggacaaaaatatggattcaataacaaatattgagataacagcctaacaattctgaaaagcaagttacagttctgtctcccactgaacaaaataataaaatttcacagggaatcaaactttaaaacaaagccacttaatactggatgttgtgtcattaagctaagtgataagaaataagacactttaataccataaaggaacaggctaaagtgtcataattagcagaaaatatcactaatgtctacttagaaaatacaagtttatcaactgaaatgttaaaagagttctttaagattgtcagatcaacacagtaacatataaacatcaataacttttctatacagcatacagtagaaataattattctactgtaatagaaagagatatcaacaacaaagttactaggaataactttaataagtaatataaaactctacttatgaacataaaggaagaataaagtatcctgagacacaaacctaattttttttaaaaagggacaaaggatatgaacaacaaattcatttttgaataagaaattcagacacaattaatcaacctatagaatatgataaagtgctcaactttaccaagtaatcagggaaatcgaacaatgatatgaaaaatgaaaactactggtcaggcctggtagctcaagcctataatcccagcactttgggaggccaaagcgggcagatcacttgaggccaggagttcaagaccagcctgaccaatatggtgaaaccccgagatctctactaaaaatacaaaaattagccaggcatggtggcacatgcctgtagtaccagctactcaggaggctgaggcacaagaatcacttgaacctggcaggtggaggttgcagtgacccgagattgcaccattgcactccagactgggcaagagagcaagactctgtctcaaaaaatagtaataataataataataattaataaaaattgaaaagaaattttaaaaataataatttttaaaatgagtgaatgagaaaaacaaattctcaatagaaaaataacaaatacagtccaacaactgaaagagtgaaagtctctgaacacatgagatattcaactaaacaattttagaaatggaaatgaaagcaaggagtatcatttcagataccaaattagcaaagagtgataacacactctgctagtcaggttatgggaaaatcgacactagtaggagtgtaaactgaacaatcaggccgggtgtgctggctcatgcctgtaatcccagcactttgggaagccaaggtgggtggatcacttaaggtcaggagttccagaccagcctggccaatatggtgaaactctgtccctactaaaaatacaaaaattagccaggcatggtggcacactcctgtaatcccagctacttggggtggcttgaacccgagaggcggagcttgcagtgagccgagatcgcagcattgtactctagccttagtgacacagggagactctgtctctcaaaaaaaaaaaaaaaaattgaagagaaaaacacaaggaaaaaaatccatgcaaaatcaatttttcagaactcctcgattaaaaaataatgtcaaacattaagaggaatatccattttgcttacagacatacctcattttatttcacgtcacagataataagttgtttgtttgtttggggacacagtctcactctgctgcccaaactggactgcagtggcacaatctcggcttactgcaacctccgcctcccaggttcaagtggttctcctgcctcagcctcatgagtagctgagactacaggcacgtgccaccacacccagctgattttttatttttagtagagacagggtttcaccatgctggccaggctggtctcaaactcctgacctcaggtgatctgcccacctcggcctcccaaagtgctgggattacaggcgtaagccaccacacccagcgagttttttttaaaatagcaaaggcttttgtcaaccttgcactgaacaagtctttttttttttgagacggagtcttgctctgtcgcccaggctggggtgcagtgggatgatcttggctcaatgaaacctctatctcccaggttcaagcaattcttctgcctcagtctcccaagtagctgggattacaggcgcccacaaccacgcccagctaatttttgtatttttagtagagacagggtttcaccatgctggccaggctggtctcaaactcctgacctcaggtgatccacccgcctcagcctcccaagtgctgggattacaggtgtgagccatagtacccagcctgaacaaatctactgacaccattttccagcagcatgcactcactttgtgtctctgtgttacgttttagtaatcctcaaagtattttgaactttttcattattattatatctgtgatagtgatctacgatcagtgatatatatatattttttcctttggttgagaaagggtcttgttctgtcacccaggctggagtgcagtggcacaatcacagctcactgcagcctcaaccttccggactcaagtgctcagcctcatcggtaggtgggacaacaggcatgtaccaccacacctggctgatttattttttatagagatggggtgtcaccatgttgctcaggctagtctcaaactcaagcgatcctcctgccttggcctcccaaagtgctgggattccaggagtgagctaccatgctatctttgatgttactattgtaattgttttggaacaccatgaaccacgcccacataagatggctaacatataatgtgtgttctgactgctccaccaattagccattccctatctctctttctccctcttttcagacctcccgtttccccaacacacaaccatattgaaattaggccaattagttaaccctaatcctacaatggcctcaaacaattcagggaaaggaaaagtcatgtgcctctcactttaactgaaaagctacaaatgattaatcttagtggggaaggcatatcaaaaagtgagaaaggcctaaggctagacctcttgtaccactcagccaattgtgaatgtaaatgaaaaattcttgaataaaattaaaagcactatgtcagtgaacatgaaacaatcttgttgctaatatgaagaaagttttagtggtccatatggaagattaaaccagccataacattcccttaagcaaaaagcctaatccacagcaaggctctaaccttcttcaattctatgaaggctgagagaggtgagaaaactgcagaagaaaaactggaagcaagtagagattggttcatgaggaaaaatgctctcgtcataacataaaagtggaaagtgaagcagcaagtgctgacatggaagctgtagcaagttatctagaatatctaactaagatcattgctggaggtggctatactaaacaaggtgttttatgtagacaaaagagccttccattagaagaagatgccatctaggactttcacagctagagagggaaaatcaatgccttgcttcaaaggtcaggctggggccacacctgttatcccagcactttgagaggccaaggtaggagaatcgcttgagcccaggagttcaaggccagcctgggcaacaaggcgagactcttgtctcttttaaaaataataaataaataaataaaaactgactctcttgttaggggctaatgcagctggtaacttgacgttgaagctaatgctcatttgccactcaaaaagtcctagagctcttaagaattatgctatatctaatctgcttgctgtctacatatggaacaacagtctcctggatgacagcacatctgtttagaggttggcttactgaatattttcagtccactgtcaagacctactgctaaggaaaaaacattcctttcaaaatattagcactcactaacaatggaccaggtcattcgagggctttgatggatatgttcagaaagaagaatgttactttcatgcctgccagtacgatacatctatcctgcagcccacgtatcaatgagtaatttcaatttttaagtcttactgtttaagaaatacatttcggccaggtacggtggctcatgcctgtaatcccagcactctgggatgccaaggcaggcggatcacttgaagccaggagttcaagaagaccctggccaacatggcaaaaccctatttctactaaaaatacaaaaataagccgggcgtggtggcacacacctgtagtcccagatactcgggggagctgagtcaggagaatcgcttgaaccaggaggcagaggttgcactaaaccaagatcgcaccactgcactccagccagggcgacaaagcgagactccgtctcaaaaaaaaaaaaaaaaaaaagtgattcctgtagtagatttgggcaaagtaaactgaaaaccttctggaaaggattcaccaccgtagatgtcattaagaacattcataattcatgagaggaagtcaaaatatcaacatgaacaggtgtctggaagaagttgattccaactctcatggataactttgaggggttcaagactcaagtggaggaagtcattgcagatgtagtggaaacagcaagagaattagaagtggagcctgaagatgtgactggattgctgcaatctcatgataaaacttgaacagattaggagttgttccttacagatgagccaagaaagtggtttcttaaagatggaatctactcctggtgaagaggctgtgaaattgttgaataacaacaaaggattcagaatactatataaccttagttgttaaagcagtgtttgagctgactccaattttgaaaaaagttctacttttgggtaaaaaatgctatcaaacagcatcacgtgctacagagaaatctttcatgaaagaaacaggcaatcaatgtagcaaacttcattgttgtcttattgtaagaaactaccagaggcaccccaaccttcagcaatcactgctgggatcagtcagcagccaccaacatcctctatcagcaaaaaatcttacaatttactgaaagctcagatgatcagtagcattttttagcaataaagtatttttaaattaaagtatgcacattggttttttaaatataacgctactgaacatttaatagactgcagtagaatataaacataatatttacatgcactggtaaaccaaaatatttgtgtgccttgctttatggtgatactcactttattgtggtagtctataatggaacctacagtatctccaaggtatgcctgtatttactttggtaccaattctagatatatatctgcatatacccaggtatttaacttcctggtctcatgttccttaaatagttaataagaaagagtaattatgaaccatgcagagcaattaacaagcctaacttccaatattttcttcactctgaagtaagtatttccaacagtgtattatgtcagaagttctcagttttgggggtgctgtatcttaatttttctgtactctattttcaacttcactgaaataatacaagctctatcttccttacaaatttataaggaatcaaatgaaatgaaatatataaaagttgtcctctttctcccatcttcaaaaaacttcccccgcacttcatttcctgttagccctctctccttcaacagcctggtctgtagaaagagtccatacatggcctccctccactccctcatcttccattcattccttgttccaaggccctcccaacaccactgaaacttttttcaatgccctttttttaaattattattatttttttaaaaagcaaattctgcccccatcttttcattctttcagttgaaccactttttccaaaacactgtgcagatataaaaaatacgtagttaaggccagggtgcagtggctcatgcctgtattcccagcacttcgggagtccaaggcaggcagaacacaggtctggagttcaagaccagcctggtcaacatggtgaaaccccatctctactaaatatacaaaaataagccaggcgtggtggtgggcacctgtaatcccagctactcaggaggctgaggcaggagaatcgcctgaacccagaaggtggaggttgcagtgagccgagatcatgccactgcactccagcctaggcgacagagtaagactctgtctccaaaaaacaaacaaacaaaaatggacaaaggagccaggcgtggtggtgcacacatagagccccagctactcagaggctgaagtaggaggatcacttgagctagaggatcacttgaccccaggagttcaaggctgcagtgagctagaactgtgccactgcaatccagcctgtgtgacagagtaagactccatcaaaaaagacaaggacaaagacatgacaagagagaaaaaataagtataaaagacagagagagagagacttcaaaaaggaggacagggcagggcacagtggcccatgcctgtaatcccagcactttaggaggctgtaatgggaggatcacttgagcccatgggttcgagaccagcctaggcaacacagcgagaccccagtatctacaaaaactagccgggaatggctgggcatggtggctcacacctgtaatcctaacactttgggaggccgaggcaggcggattgcctgagctcaggaattcgagaccagctgggtaacatggtgaaaccccatctctactaaaatataaaaacttagccaggggtggcagcatgtgcctgtagtcccagctacttgggaggctgaggcaggagaatcacttgaacccaggaggcagaagttgcagtgagctgagatcacaccactacactacttcactccaggatgggcaacagagcgagactccatctccaaaaaaaaaaacaaaacaaaacaaaaaacaaaacaaaaaaaactaggctgggcacagtggctcacacctataatcccagcactttgggaggccgaggcaggcagatcacctgaggtcaggagttcaaggccaacctgaccactatgatgaaaccccacctctactaaaaacacaaaaattagctgagcatgggggcatgcgactatagtcacagctactcgagaggcggagacaggagagtcgcttgaacccgggaggcagaggttgcagtgagccgagatcgcaccattgcactccagcctgggcaacaagagcgaaactctgtctcaaaagaaaaaaaaaaaaaaactagccgggcacagtattgcgcacctgtattcccagctacttgggaggctgagatgggagggtcatttgggcccagaaattcgaagctgcagtcaactatgattgtgccaccgcactcctgcctaagtaacagaatgagatcttgtaatttaaaaaataaaaggataggtaggatttacagactggaaaatgggaaaaagatgagagtggaaaaaggaaggaggggtagcacgaatggcgggcaggtggacagaaaagtaaaattcagccatgttcaaaagggaacaaataaaagcaccgaaaggtaagacagacctagtatatttatgacttgaatcccaagctacgaaactggaacataatttagcagagagactccaaaagttttacagcaaaaagtattagaatcatttatatactgggaaaaaatagcctcctcattttaataatccagattgggaaatcagatctaaaacagatgttcaatggacatcccatttcttttgtaaaagcaacttgagtggtcagtcatcaagttttgttctgtttttaattcacaatgaaaatctgactactcatttattcaacaaatatttgagtgccagctatgtgctaggcactgttctaaacacgccaataacatttatttagtgggattgattctgtactctagaacaatggttcttaactggggagagggagtaatttttgctccccaagggacatctggcaatgtctaaagacatttttggttgtcacgggggcagggagggggggaggggtgcgggtgtgctactatatctagcgggtggaggccaggaatgctgcttaacatcctacacacaggagatactgcccatgacaaggaattagctagtccaaaatgtcaacagtgccaaagctgaataaatctgttcaagagcaacacatttctattccctcttccatagtaattgttaataaacattagttccattttctactatttctgttctacaatagaggctttaaaatatcttaagaaatataacaccattttaataatttggcaagtagaagtaaagataccatgaatcctgagatttcactttcaaaaatgtataagctacatttattttacaatataacttttaggaacaaagttgtcttctccttctgacactgactgttatcaaaaactgtgctaaaagctttgagtgatgtttgattattccttttattttggggtccttatagcagttaattaccacattctgccagttctttccaagtgaatgcctcacatttcaacggatccttttctattaccaatgtatcatctgaaatattttactaactggtttttctgaagctcaatgtccatgtctccttccctcccaagctatccctacccattaatactgtatttttcacctgctcaaaagtccatatggttgcccgtaacataccaaataagaacctaattcctaaagcttgacattcaaatccttttttcaactagctacaatccacttttccaactcttttttccactgctctccctcaggagtagccttttttagcaaaatgacttattctgagatacataaacaacctttccagatcagagacatcaaaagccattcaggcttcattgagacaaaagatacgcattcaactcagaataacagtaagaaatcaacttatagggaaaccagatctagccatgttctataaacatgagagataaccctgttggctcatgccactgtccttatttataacggcccctatttgcctttctacttctctgaactccttatccttcaaatctaccatcttttcaaaaacccaaacacagagtcacctcagtcaccattacctgcccttcccccaccccacccaatgcctgtggctttcaggtcatttattttgcaataaacttgtcatctcaattttactggttctcttttagattcagacagctgagattatgatagattcattagtaagctgaatggggaagaaaaggatatttacattcccaggccaattttcaatgctttttggaagattctgttaaattcacaatttccagaactggcaaggaataggtaaatatatacactcatatattactggtaagagtataaattggtataattatcctaaagtgatatctgccaacattgaaagtctttaaaatctgtatactctttggcctaggaattcaacttgaaaatttatcatgagtaaattataaaatgtacaaaggtttaactataaagacactcatctctgcattgtttctaactctcaaagattgaggtggaggggaaaattccttgtccaataaaaaaagactattccatgaatcatttatttaagtaatgtaatactctgcaactactaaaatcctatagtatcatggttattgacatgtaactcttttaatggctttctttcctaagctaagaaaaatacaaacatgattccacataatgtatttcaaatatttgtatacatttttctacttttctatattttccacacatctatatataatttgtgtgtgtgtgtgtgtatgcatgcatgtaaataaaatatacctctaagtcttgtaaccttaagatggtggggcaaaatatttttattttctgttgttgattatttaaaatttagctacattaaattttttctgatttagtaaacatacataaggcctatttatagttgaatggcagtcttacaaaacctaagcaaccttagtttacattatctgtgggaaaagcatttttagtagaatgcttgcacatcttcctacattcctgtaatcaaacagtatttatcatcaactatgttggtgactctcactttgacataggctgaaccagaaatcctaggaaaaactgatgatagaaagctaaggggaaggacaggaagccgggaaaccctgggaaaggagggattatattacacatgttatgggaactagtttgtatatgcggggcacagagcatacacttagataagaagggggtcataaaaccagaaaggcaataaatagaatgttatgagcatgaactctagatgcagactgtttaggttcaatcccacctctgcttcttactacatttattaccttaagcaagtcacttaacttctccctgccgtttctgccccatctgtataatggggataacagaccctaccttagagggttgtcacactaatgaattctgagaatagtgcctggtactacagttaagtgctcattagttgtccacactcatcatcgtcattactcctattactatgacgtgaagagttgtgctgctaggacaggagcagcaacttttcaacaccaatcacttttttagatggcctcctttctagccttgttagttgcccaaattctgaaaaaaaaaacaagaactaagactctagaaggagatccgagaggcagacatgtgtgtctgtgtgtgtgtgcgtgtgtgtaggcgcgtgtgcatgtagatgaaggaggaatcaggagtaatgccaagaatgagaaatctgtataagcagttcagaaaaggggcatcatgagtcactctcctcagtgctgccccaagagttccacagtttgttccttacatcattcacttggataaaacctttcaatgtctctccatggccttcagagttaaatcaaaactattccttggaatgacttaaaacccatactacctctaaagcctcatctcttgactctctcgcaccaagctcactgagcttccagccctactgaatttcttcagtaacaaactctcacatctcagagcctttgcacatgctgctccctctgcctgaaaagtaacctctacctcctccaatagcaaactgctactcaaccttcaaaatgcagctcaaggataactccagagctctttcctgatttcaagctaaatgcctctgctatattatcccccatgtgcataacaccaccaccaccaccaccaccaccaccaccaccaccaccaccaccaccaccaccaccaccaccacgctgcactgatccaccactagccgatgactcctttagagatcttgtctttgggtatttccagatactgtcctatacagtaacagatacattaaaaataataattttaaaaatttattaatcacagctggaaaatacagtgaacctactgattacactggaaactggtaaagaaaggtaaacaagcaaacatttattctgcctttcccatatgaacagttacactgggcaaccaagtaagaggtgatggaaacttttctttttataaaacagtattccagataataaaatgaaggagtaacacaactagaacattatcattttacaactcttaatgaatcaacagatctaggcattagtcaccaacagttgctaatgtcacaaaaagagacaaccatattttgtgcctcctgatgaaagaatgcaccacaatataagaagcagtcttataaaataagactgaacctgactctgaccaagcctctggttctaactactcatttggaaatacagaaaatagagaaacatcggggataaacctggtattgaatctcaggaatcagcaaaatcctgactacaggaactctacagggcaaataacccatttctttaacaaataaattgtgagaataaaaaggaaggtggtatcctacagattaagacacttaatcgcaataagtaagccttattcaaatacttttaaaaattgagacgtgttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaattgagacgtgtttacctgaacatagaatatgatgatattatggatttaactgtcaatttttttttaagtatgatggtggtattaggtttttcttaagccttcactttttagaactacattctctaatatttataaacgatatcacattatgcctgaggccaggtgcagtggctcatgcctgtaatcccagcactttgggaggctgaggcgggtgaatcacctgaggtcaggagttcaagaccagcctggcaaacacagtgaaaccccgactctactaaaaatacaaaaattagcctggcgtggtagcactcacctataataccagctacttgggaggctgaggcaggagaagtgcttgaacctgagaggcgaggttgcagtgagctgagatcataccactgcactccagcccgagtgacagaatgagactccgtcaaaaaaaaaaaattaataaaaataaaaataaataaaagcacagaccctacagaaaagactgcctgggttcaaatcctgtgtccatgactcactctgagccttagcttcctcagctgttaaaaaagaaaaaaaaaaaaaaagggacaatagtagtctttacttcagaggacttttgtaagaattaagtgagttaagatggttataacatatagttctcccaaaacagtgcttcatagaagttttcattatcatcccccttcccactttacagaaagaaacacggacctggagaggtgaaaagtgacttgcttaatgacttgaaaaccatcttccaggaactgtgcttagcactggtggcaaaaactggctatttaccaaagcgtttccttttcctcctggcatatggctaaactacatttcccagcttccctttcacatgactggtctggacaatgaaatgtgggcaaaagtgaaagatgcctctgtactactcccaggccttgtccccaaacctcccatgcaatccctcaccgcttctcaccctcatttgccaggtggacatcaatgcctagggcaacggagaaaagattagcctgagtcccagtatgacttaactgttactgtgttactcttgaaatttcggccaccataaagtcagtaagactgtattttttatggactcatcacaacaaccattattcctattcaacagttgaggaaactgaagtataaagaaagtcatggtcaattactcaatggtagatccagaacttgaaccagcactgtcttaatacagagctcgggatcttaagtgacttccaagatcacaagaccagtaagggcaccaagatttctaacttagagtagatacattttatatagaattttgttaagtattccttaaaatatcactttaatatgccataagaataaccacagaatagtgttactttaaagtaaaaagatataaataggagcccaaaatgttaagtggggttttacaatcaagaagacacaccagaataagatattttttaaataccatgtacattaaagagatcatacttccttaccctaataaacagccatgtagtacaagttttaactttttaattaaatattaaaattattaaaaatattaaatatacaacttctatttggttttatctgagccattcctttatactgacagttacatgatgtgatttcagttatatatgtagttattggtaatttttcaaaaatagaatataatgaaaaaacttcatttcaatcattactgaactgcacctacattaatcacaatatacctatgaaaagatgtataacatatactagtatgccaaaaaaaaaagtgacaaaacagtatttatagtataattccatttttttttttttttttttgagacggagtctcgctctgtggcccaggctggagtgcagtggtgccatctcggctcgctgcaagctctgcctcccgggttcacgccattctcctgcctcagcctcccaagtagctgggactacaggcgcccaccaccatacccggctaattttttgtattttttagtagagaccgggtttcaccgtgttagccaggatggtctcgatctcctgacctcgtgatccgcccgcctcggcctcccaaagtgctgggattacaggcgtgagccaccgcgcccggcctaattccatttgttttcaaagaatatatatgcctatgtctgtatttttttctacatacatacacgtcttatctacaaaccaaaaacatctagaaaaatatacaaaaaaagcttccagtgataacctctggggagtaaaactgaacttgtgatgtataccttttcttagaatttgaatttatgaaaagcacatatacctttagaataaaaaatactttaaagctctatcatttacagtaatgcaaagtgatccaactctgaaattcccacataatcatgttatgcagtgaagctttctaggctggggggaaaaaatgtaacctcttcaaaaaaaaaaaataaataaataaaaataaaataaaaaaattgtaacctcttataatgaatatataaatatatataatttcattaatttcattcattatgggtatacatttatacatctatttacaagtaagtctgtttaaatacacatatccacacctgctaaataaataagtatgctctggccaggcgtggtggatcacgcctgtaatcccaacactttggaatgccgaggtgggtggacctcctgaggtcaggagttcaagaccagacttgtcgacatggtgaaaccccgtctctactaaaaatacaaaaattagccgggcatggtggtgtgtgccagtagtcccagctactcgggaggctgaggcagaagaatcgcttgaacccgggaggcggaggttgcgtaagccgagattgtggcaccgcactccagcctgggcgacagagcgagactgtctcaaaaaaacagaaacaaacgaaaaaagtatctaatcaggagattttggtaagcttttcaagcacacccttttttgtgaaactgagttctaacctgaagaatacctgggattgtatggcgaaaaaacacaatatattaaaattttaaaacagttcttattttaggctcaaattttatgttttggggactacttagacttttttttttttcctgggatggagttttgctcctgttgctcaggctggagtgcaatggcgtgatcttgggttactgcaatctctgcctcccgggttcaagcgattctcctgcctcagcctcccaagtagctgggattacaggcatgcaccaccatgcacagctaattttgtatttttagtagagacagggtttctccgtgttggtcatactggtctcaaactcccaacctcaggttatccgcctacctcggactcccaaagtgctgggattataggcatgagccaccgcgcccgaccaactttttgtatttttagtagagatggggtttcaccgtgttagcaaggatagtctcgacctcctggcctcgtgatctgcccgcctcagcctcccaaagtgctgggattacaggcatgagccactgcgcccagccaactgtcactcttaatttttttaaattaaaagaaattaaatttctcaattctggagactggaagtcccagctactcgggaggctgaggtaggagaatcacttgaacctgggaggccgagactgcagtgagcagagatcgtgcagcctggtgacagagtgagactccgtctcaaaaaaaaaaaaaaaaaaaatactgtcacttacgtcactcagtttgtggtattttgttatggtagctctagcaaactgataggagaggcctctagtttacactatttaaattttctaattatttactttttttttttttaaatacctggtggagtgcagtggcacaatcacagcttactgcagcctcgaactcttggcctcaagcaatcctcccaagtagctgggactacaggcatgcaccaccatacctggctaagttttatttttttgtagacatgaggtttcactatgttactcaggctggtcttaaactcttaagctcaagtgatcctccagccttggactcccaaagtgctgggattacaggtgtgagccaccatgctcggcctacacgaactttttttaaactagcaggggttatgtgaatagtgggattacagacattttcttcattatgctggtccatatttaaatcctctccccctcgcaaaaaaaggtaaaaatatacagccataaaaaagaatggaatcatgtccttcgcagcaacatggatggagctggaggctacactctttttcatcctctatcctaaaagaagtaactcagaaccagaaaatcaaataccacatggtctcatttgtaagtgggagctaaacaatgagtacatgtgaacataaagatggaagtaatagactagagattccaaaagagaaggtagaagaggaggcacacaggttgaaaactacctattgggtactagggtcactttggatgatggctgcgctagcaggccaaacctcggcattacataatctagccatgtaacaaacctgcacgtgtaccccctgaatctaaaataaaataaatttttttttaaattgtaaagaaaaaaagtattaaatgacataactaaatattctagacatcattctaccataagttgtccaagaaaaaccacattttaccttactgtttatcatttgaaataaaatattatgttaagatattttaaatttttaccagttccacaaaggaactaggaagtagaaactgaagaacactttgttaaacaagtccttggggattaaagaagtaatagctacgaagtatacaacagtgtgatgagtgaatccttctcatattggggttaaaatggtcattatagctactgagtaccacaaatccaatcaagttaggtattttgtatacattatcatttaattctcattacaacccatcacaatagatgttaattagtatgtcccctatttttcggataaggacattcaagatcaaacagattaaatggtcaaggtcatacaactaagaaatgaaagtgctgagactcaaacccaagttcatgtcttaaatcccatgccgtttgatattaaggaccatgtgtgtttaacaaatattagacacctgctacacacacacacactgtgccagatgtataagatagagccatgacccaagaaatacagtcactattctcaaaaaacttagaatctctgccaggagcaacggctcacgcctgtaatcccagcactttgggaggccgaggcagatggatcacgaggtcaggagttcaagaccagcctggctaagatggtgaaaccccgtctctactaaaactacaaaaattagccagtcatggtggcaggcgcctgtaatcccagctacttgggaggctgaggcagagaactgcttgaaccagggaggcggaggctgcagtgagccgagattgcaccactgcactccagcctgggcgacagagtgagactgtctccaaaaaaaaaaaaaaaaaaaaaaaaagccttaaaatctcctctttaacattctgttgcatgtatgtttttcctaggttttttgtcgttgtttgttttttgtttgtttttttgtttttgagacagtcttgctctgccacccaggctgaagtgcactgactggttccatctcagctcactgcaacctccgcctcccgggtgcaagccattctcccgcctcagcctcccgagtagctgagattatggtgcctgccaccacgcctagctagtttttgtatttttagtagagacagggttttgccatgttgaacaggctggtcttgaactcctgaccttaggtaatctgcctgccttggcctcccaaagcaatgggattacagacatgagccactgcatgcccggcctttttttttttttttttttttgacacagagtctctggcacacaggctggagtgcagtggcacagctcactgcaacctctgcctcccaggttcaagcaattctcctacctcagcctcctgagtagctgggattacaggcacacaccaccacaccgggctaatttttgtatttttagtagatacggggtttcactatattcaccaggctggtctcggcctcagcctcccaaagtgctgggattacaggcgtgagccactgtggccgttcttgtttttcctgtctttgtaactagactttaaagctcctcaaaagagctggagtataaacgaaaacacaaagagctttgagtctcagatctggaaaaattctagctttatcatatacatacataaatttaaatgctggattcctcaccagtaaaagggtcttggattaagtgatataaagtagtcctgtgcttatccataggaaatacatttcaaccccataccctacccctgcctggctcccataaatgcctgaaaccacggatgctacaaagccctatatacactatgttttatatttttctttgcctgcagtgaattccctctcttggcaatgccttataagttaccatgcaaaaaaatataaatgtatctcatttatctgttctcccctaccccccacaaccctacctacctctcacaggaccaagaattggaaaggccttagtgtagccaccacctaaccacagaaatgatccaaactcacatactactacttctttatttttcagtaaagttctccaaactaaaatgaaatatgcagtttgaaaataggtagtaaaaatacagcttttaaaatatatcctctatgctgtttcatagccacttcacaatgaccctacttccccatttataactcacctagttagttattagtaaacaactcttaatcaaaagtaaaaatgaagggctatggaactgttctcatatccccttcagtgtcttaaaggcactgtgctcagcattccacatgcattatcttattgaaagcgcagtgtttaatgaacttgcctaaagtcacatcagaaccaccaggaagcacaatttcattgtattttgtgtgaatgccctccccagcacaacaagaacggagctgtacaatgaagtggtctgggtcacacagctaattaagtaatggagttaaggctcaaaaactcttcagtatctgatgagaaagctcacactcaaaacctccaaaaaacactgcttcacatcactgaaattaaagaacaataatacaatataagtaaaataaaatgagaattccttgttatataataagccagtttatcagctttttttgaaggaagaaagggcaacatagtgatatcttgtctctactaaaaatttaaacattagccgggtgtggtggtatgcacctgtagtcccagctactctggaggctgagtagagggaggattacttgagccagggaggttgaggctgcaaggagccatgactgcatcactgcactccagcctgggtgacagagtgagatcctacctcaaaagtggtgttttgtttttttccaccaccccaatgctacctctataactcacacatgatagttttataaagataactacctggcattcaggttaaaatgacaactgcacccagaataggaaaaactataaattatgcattggactctgcgatcaccagcccctacttgtaaatttcaatggagattcactttatttcaaaattagaaaactgatctcagagtttaaaacctcatttacagctccaaaatatttagaatctagaattatataacaaatacttactttcttagcatgcaaaaattatttacaaatcatttaaaaaggatgatcgacttaacagaaaaatgggcaatgacaaacagactattagttacctaaccaatagccactccccactcacaacctgttccttacagagtccacttcccattatcatggctgcaaggaacatccttgctctctcaccctcacttgtatctaggacatggatggataccaatcacggctgatgggatttaagaaaaaaatctgttggccgagcgcggtggctcatgcctgtaatcccaacactttgggaggctgaagcaggcagatcacctgcctgaccaatagagagaaaccctgtctctactaaaaacacaaaattagccgggcatggtggtgcatgcctgtaatcccagctactggggaggttgaggcaggagaatcgcttgaacccaggaggcagaggatgcagtgcagtgagccgagatcgtgccattgcactccagcctgggcaacaagaagcaaaactccatctcaaaaaaaaaaaaaaaaaaaaaatctgctaagggcttccaggaaaggtttttaattccaaataaaatagatgtgcatgaacaaatatacttcatctttactggtcattgaacctggtgtgaactacgaatcctctttttctcacatgccacatccctcaacaaatcttttcggctctgcctcaacatatgcagaattacttcaacatttctctgatgcctatcatgcttcaaatcatctgttaccctgctaatattatctaacatgcctgcttcttccttgatctccttcattctagtctcaacacagcagccagcatgagagttttagagtcttggtcagataaagccagtcctccacttaaaagcccccaaaggactctcatctaatccagagtaaaagtcaaaagatctcacaatggtctacaaggccctgcacaatctgactccccacgctacttctcttatgatgttttctccataactcagctcctgccacactggccctttcagttctatgaacatgctaagcacattcctgcctctggggcttttgcactcactgttccccgcatcagcaatgctctttccccaaatatctgcctttgcattcttatttcttttaagattctattcaaacatcagctcactgaggccttctctgatggccccacttaaaacaatccaacccagcccttcccgtcccttccatggctttatttttttccataaaacttaacatcttctgacaatctataaattctacctatttgtttgactgtcttctcccttatccccactaaaatataagcccgtgaaggaaggcaatgaactttgttttgctcactgctgtatttcccgtgcttatggactactgcctaatacattttaggtggtaaatgattatttaagtgaattaatttagcaactatcgacaacaagctgagtataaaacagcaggaaaatgaaaaccatctaggtccgtgataatttaattgagccactgaattacacctggacttccagtcatgtgaggtaaattttatttatggtttaatgcatttttaattaaaatttttcttatttgaagctgcaaagtacccgaaatagggtactggtaggcagtttgcaaaaaaaagtgacaaatataatcaatttaactcaatcgtaaggcatgccaattaaaataaccatgaaataatctcactcaagaaaaaataaaagtttggtacatgtataatcccacttaatatgactcattacaacaatagtagcattaaaaaaattttaagggttttttgtttgttgagacagggtcttgctctgttgcaccggctggagtgcagtggcgcaaccatgactcactgcattctcgaccttttgggctcaagtaatcctcccatctcgactcctgagtagctgggactacaggcacgtggccgcacacctggcttttctttcccccccccagttagagacagtgtctcactatgttgcccagcagactggtctcgaactcctgtgcttaagtgatcctcctgtcttagcctcccaaagtactagaattataggcatgagccacagtgcctaaccatttttaagttttgttttgttttgttttgttttgtttttgagacagtctccctctgtcactcaggctggagtgcagtggcgccatcttggctcactgcaacctccgcctcctgggttcaagtgattctcctgcttcagcctcctgagtagctgggattacaggtgcctaccaccatgccaggctaatttttgtatttttagtagagacagggtttcaccatgttggccaggctggtctcaaactcctgacctcaagtgatctgcctgcctcagcctcaggcgtgaaccaccccactttctaagttttatacctaaatattaatatatataactcagtaagagtgtgatatcctatcaccagtattttccccacactttgagtgctagataggactgcccactcttagccaattatataaaaatattagttgatgctgataaagtgcttcctcttgtgctggccacttttacatgtgtaacttactgcccgcaacaatcctacaacctacaaaaccttgttttcccattttaaagctcagaagactgagctacaaaaatagatcaatgatcagccccaaatcaaacagctactaagtgtgaggctgggatttgaacataggcagttctgaaaaccaaaacccaaagcattacaaacactatcacccataagcagagcattctcctaaactgaatgtgccttttcctgccatttattctgtgtttggattctgacccacaactactgacaaaaggtattcaagtaacagcgccaaacttcccaaaagatattttgacagaaaaaaattaattaaaaaatacataaatgaaaagacaaagattggtggacatcctctgtctcacttcaagaaatcgagataataacagtaattactttttaggttgttgtgaggattaaataaattaatatagtacgtgtaaagcacttaggatagtgcttggcatacattaaaccaattaatagttttcattttcattgtaattctcataattattatgaaaggctccataaataccactaagcctagaaggactgaccaacagctatatgattagtaactggaaaaaactatggccagagacatgttatgactttagggataccaaaaagaaaacgacaattgctgattttcattctaggaacaaagtgccaaagtgatttagtaaagaaaaaatgctattagaactcccactcccattttcagaaatgtaggccctgcctactttctctcccaccaggtatgttgttagtgaggatgccaggaaaaaggcatactctgttgggggaatccaagccaacacctcacttttggagggcaactaatgaatatccatcaaaacttgaaacatatgtactgtcctcttcgatgagagaactttacatctaggaatttatcttccagaatatgtccacacgtacaaatacacaagtacaaggatattccttacaaagataataaaactggaaatcaactaaatgaccatcagtaggggaatggtttaactaatcagagggccttcaatctagtttaaaacctgtttctccactaagatcaatctctaatctaagtaaatgacatttctgtccactcaactactgaagccacaaatctagaagacaattttaattcttctttatctcatatccatctcatcaaatcctttagcagatcttaccgctgtaactttccaagctttttttttttttagatggagtctcactctgttgcccaggttggagtgcaggggcttgatgtcagctcactgcaacctccacctcccaggtacaagcaattctctcctgcctcagcctcctgagctttccaaacacttctgattgcctttctcctctgccatcactctactctaagccatatctgtcaaggttactttcacagccttatgggtgccctggtttataaccttctaagggcttttgctgcactaaggataaaatcccagcttcttaccacggtgtgaagggcactgcttgggctcctgcttgcctctcaaatatggtctcctaagttcccctcattgcacagtaacaccaatcgtttattttgggagatgggaggatcccttgagtataacacacttgatatggtttggcagtgtccccacccaaatctcatcttgaattaaagctcccataattcccacgtgttgtggaatggacacagtgggaaagaattgaatcataggggtggtttccccatactgttctcctggtagtgaataaatctcacgagatatgatagttttgtaagaggaaacacctttcacttggtactcactctctcttgcctgccaccacgtaagacatgccttctgctgtgagtgtgaggcctccccaaacacatggaactatgagtctattaaacttctttttctttaaaaattacccagccttgggtatgtctttatcagcagtaaacgcactaatacaacactcattcttgttttgagtcttcacaataaatcctgctcttcctaaaatgcctccacatcattcacgtgtgtttcaatgccatcacttcatacagaccttcctgaccaccttagccacatgcgttctctctcataccattaacagacacactcagtacagtaccacattttattttcttcatagcacttctcagtatttgagactaattacgagaaatgcatttattttgtgtttctcaccgttgaaatattgttccataagggcaggagcttggtctctctggttcaccactgaatccttacacctaaaacactccttggcaaattaagcacgtgattcatatctttggataaattttgaaaagaatgagatagatgtgtataagctaaaatggaaagatgcctaagatcaaccacaaagtgacaaaatcaaatcacgatataaattaaatgatcccattatcataaaaatggatataagtacatacacatacatagaaatagcaaaggtatacccataacaaaagtcaaggatacagtaattgtctctgaaatgtggggcaaaacagggaaaagagggtctttcacattttttgttttttattttagataagaggctcactctgtcacccagtgaaacacatgttgcccaggctggcctcaaactcctggcctcaagtgatcctcctacctcggccttcccaagtattgagattataagcgtgagccccctgcacccagccccttttactttttaagttatgccctcctgtgctctttatttttaccagaatgtattacattcataactttttatgtgacatcttctaatcttccacatactgtaaaaggcttaacacacataatgagtactcagttttgttttggagacagggtttcagctctgtcacccaggctggagtgcaacagcacaatcttgactcaatgcaacctccacctcctgggctcaagggatcctcccacctcagcctctgagtaggtaggactacaggttcgcaccaccaagcccagctaatttttgtgggatttttttaggggtagggtttcaccatgttgcccaggctggtctccaactcctgagctcaagcgatccacccaccttggcttctcaaagtgctgggatttcaggcgctcaccaccgcacccagccagtactcgcttttataaacacgcaaaacacctcctacaccacttaaagctgctattatatttctacaacctaacacattctgaaacactggataaataaatatctaaataattattagtttttggtctagtccagtttgagaactgaaagagattctctggctcaaatagcagatcaaacatatacatttatctctcttcagcaaaagaccattttaaacagtagtttaaaaaaatttaaagccaaattattattaaaaaacaaagtaaaattaatggaaagagatctcttctaaagtaaagaaactggagtctgggagagaggaaactagtgaacctagcatgggagttggcactttggggtaaaacaatggactcttgaatgtcagaatacaaaagactaattaacagcttaaccctaaagtaaagcctgcctgccaaccattaattcccaccaagagctcattgtgaacccttctactaaatcttaaagctgagtgatatccaaggtcagcagatatttggttaaaagcctacaatataaatgagactaagataacaacaaaaattacaatagagttgacaggtaagagggagggcaacaaaatttaaaaaaaaaataaaccttattaacattttcagagactcaagaagattattaatccataaaatgagaaaagatattggcgggggaggaaatgaaggagaaatctcaaacatttaaaatataacttccaatataaaattaaaaggtccaagaataaataaagtagaagagatggccagaccaaaaaaaaacaaacaaacaaacagacaaaaatattggggaggattaattcagtaagtctaataatccaactaaaagcagctatagagaaaacaaagaaaagatcactagaggccgggcgtgggggttcacgcctgtaatcccagcactttgggaggccgagatgggcggatcacgaggtcaggagatcaaaaccatcctggctaacaaacacggtgaaaccccctctctactaaaaatacaaaaacttagccaggtgtggtagcaggtgcctgtagtcccagttacctgggaggctgaagaagaatagcttgaacccaggaggcagaggttgcaatgtgccaagatggtaccactgcactccagcctgggcaacagagcaagactccgtctcaaaaaaataaaaaaaagaaagatcactaaagccgtaacatgaaaactttcaagaagtgaagcacataaagtattttgcttattgtaatggagaagaaaacacatctggacatctttgagaaatttcagtttaatgaggataaaagaaggctctaaagggatggatgaaaatatgaaacacatcacccacaaaggaagaagaatcacacagtatccgacttttcctcaccaacaacaatggacatagaagacactggagcaatcccttcaaaactctgagggaaaacaattttcagcttaattgcacttgaataaaataataccagtcaactgtaagggctaatgaggacttttacagataagcaaggattcaaaactttatttctcacatattctttcttagctatttatgtgggtgtactgcattaaaacaagttagtaactcaagaaatgataaagctctaataacagtagtagcactgtgcaaaaagagtaaggaaaagttcagcacaaaaacaaggcaacaggtctaaatacttctagcccaaactgaaggaaataggactaagggaaagcaggggagggtgggagggacttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaagcaattctccctgcctcagcctcccaagtagccgggataacaggcatacgccaccacgaatttttgtatttttagtagagacggggtttcaccatgttggccagactggtctcggcctcccgccctcaggtgatcagcccgcctcagcctcccgaagtgctgggattacaggtgtgagccaccacgtccagcccattaactttcaagtattaaagtcataccggccaggtgcagtggctcacacctgtaatcccagcactttgagaggccgaggcaagtggatcagttgaggtcaggagttaaagaccagcctggccaacatggagaagccccgtctctactaaaaatacaaaaatttgccaagcacggtggtacgcacctgtagtcccagctacttggaaggctgaggtaggagaatagcttgaacctaggaagcggaggttgcagtgaaccaagatcgcaccactgcactcaagcctgggcaacagagcaagactgtctcaaaaaaataaataaataaacaaacaaagtagtaaggagtacaatacagcgcataactgttctcaaccttgacaatgtcaatgtcagaaatgacagatgtaagcacataaagggaaaaggaaaggtaaaaagaagagttgcagccgggcgtggtggctcacacctataatcccagcactctgggaggctgaggcaggtggatcacctgaggttgggagttcaagaccagcctgaccaacacggtgaaacctcatctctactaaaaatacaaaattagccaggcatggtggcgcctgcctgtaatcctagctactcgggaggctgagacaggagaatcgcttgaacccgggcggcagaggttgcagcaagccgagatcgcgccattgcactccagcctgggcaacaagagtgaaactccgtctcaaaaaaacaaacaaacaaacaaaagttactgcttggtacatcaagatcaacagtctatataacatgaaggaaagttctgatataaactgcagagataactagcagagaaattaaaagtgatttttaaaaaatctattggggaagcagatgtaaagaagccaaatcctcctttatcagagcagaaatcaatcataaatcataacatatgtatattatatagtcacgacaataccacaggaagaaataatttgaaagtttcctttggaaattggacccctatctttcaccatatacaaaaatcaactcaagaaggattaaagacttcatccaaagacctgaaactataaaaaccattagaagaaaacctaggaaaaactctcctggacactgatctatacaattcatgactaagaattcatgaatttaaagaattcatgactaagacctcaaaagcacaagcaaaaaaaaaaaaaacaaaaatagacaaatgagacttaagctaaaaagcttctgcatagcaaaagaatcagcagactgaacaaatggcctacagaataggagaaaaaagtttcaaactatgtatctcacagggtactaacatccagaatttacaaggaacacaaataatcccatcaaaaagtaagcaaagggctgttctgaatacctcactactgataactggtagtgagttatcccaattgatggttcactgtcagttaccgatcaaattccttgttctatactctttactcccctttcactactgcacttaactggtcttaagaaaaaattttaataaaaaatttttaagaattttaaagttagcaaaggacattaatagacatttctcaaaagaagacatacaaacagtcaacaggtatgtgaaaaaaatgctcatcactaatcatcgaggaaatgcaaataaaaaccacaatgacatatcatcttacaccaatcagaatggccactattaaagaaacaataataataacagatgttggggaagatgcagacaatggggaacacttaacacactgtgggcgggaatgtaaattagtaccacctgtatggaaaaccatataaagagttctcaaatgactaaaaaataaaactgctggccaggcacggtggctcacgcctgtaagcccagcactttgggaggccaaggcaggtgcatcacctgaggtcaggagttcaagaccagcctggccaacatggtaaaaccctgtctctactaaaaatacaaaaatttgctgggcgtggtggtgtgcacctgtaatcccagctactcgggaggctgaggcaggagaatcacttgaacctggtgggcagaggttgcactgagccgatatcatgtcattgcactccaacctgggcaacaagagcgaaactccatctcaaaaaagtaaaaatgataaaaaataaaactgctattcaatccagcaatcccactattgggtatccacccaaaggaaaataaatcattatatcaaaaagataactgcactcgtacctttatcacagcaacactcacaatagcaaagatagggaatcaatctccatatccatcaacagacgactggataaagaaaaactgggacacatacacacacacacacacacacacacacacacacacacacacacacgaatactattcagccataaaggaagaatgaaatcatgtcttttgtagcaacgtggaaggatggaaggacctggaggccatgttctcacttataagttgaagcaaaataatgtgtacatgtgggcacagtgtggaataacgacactggagactcagaaggttgggaggctgggaggagggtgagtaacaagaaattactgaatgggtacacgtacattatttggatgatggatgcactaaaagcccaaactgcagcactatgcaatgtattcatgtaacaaaactgcacctgtaacccttaaattgatacaaaaaagttgtttggagagtggcaataaggagtgaaacagaattcttgatccttattataagcattctgggctattagacttttttcaaccatgtacatatattactatgcaaagtttttaaatggacttaaaatctgaaagaacattgatcttttaatgaaaaacaaaaccataagatactctgcctaaactttccctcataatgcaatgaataaaactttaatctttctcttcaggataaataatttctgaggctttagaaccaccttaaaaggtatctctaggccgggcgcggtggctgacgcctgtaatcacagcactttgggaggccgaggtgggcagatcttctgaggtcaagagttcaagaccagcctggtcaacatgctgaaaccctgtctctactaaaaatacaaaaattagccaggcgtggtggtgcacatctgtaatccagctactcagaaggcggaggcaggaaaatctgaatccgggaggcagaggttgcagtgagccaggatcgcagcactgcactccagcctgggcaacagagcaagactcaggtctcaaaaaaaaaagatatttgttgacaactaaataagtcaagttacatgatgtatagactatcatcaaaattactgaaccgtcactgcttatcaaagtaaaatgtaaccaaaaatttaatgcacagtacttcgaccagaccaaaacattcaattcatccatagtttcctaattttaatacttattttaccagagcatgaaaatcttttttgtttttttgttttgttttgttttgttttttgagatagggtctccctctgttgcccagtttggagtacagtggcacaatctcagctcactgcaacctctgcctcccacgctcaagcaatcctcccacctcagccttctgaggagctgggaccacaagcgtgtagcactgtgcctggctaatttttgtattttctgtagagatggggtttcttcatattgcccagctggtctcaaactcctgagctcaagcaagccacccgccttggcctcccaaaatggcaggattacaggcatgaggcaccacaccccaccaaaaatgtatctttaacacctgttctctagattgatttaggttttactgatcttagaggtatatacaaccatcatttcaaactcaacagatctaaatttagtttaacttcacttttttttttttttttttttttctgcccaggctggagtagtggctcgatctctgctcactgcaacctccaccttctagggtcaagtgattctcatgcctcagcctcccaagtagctgggattatagacatgcaccaccacacttggctaatttttgtatttttagtagagatggggtttcgccatgttagccagactggtctcaaactcctggtctcatgtgatctgcccaccttggcctcccaaagtgctgggattacaggcaggagccactacacgctgcctagttcactttgcattctattttttcctttgtaccttttagaagaagcttttaaataatataaagattattatttttcaatctgtcagaaattgacagggaaaagaacttaaaagtttaaatacacgatacaaaaagattaaaaagttatcgcaaattggcagggtgcggtggctcacgcctgtaatcccagcactttgggaggccgaagtgggcagatcacccaaggttgggagtttgagaccagcctgaccaacttggaaaaacccagtctctactaaaaataaaaaattagctaggcatggtggtgcatggctgtaattccagctactcgggaggccgagggaggagaatcgcttgaacctgggaggcagaggttgcagtgagtcaagatcatgtgcgccattgcactccaacctgggcaacaaaagcaaaactctgtctcagaaaaaaaaaaaagttatcacaaattattgctcataacagtttagttaaaataaagaatgtatgtaaaactacagagtaatagcttgatagcaagacaaaatagtttttaaaaaaattctaggaaaaatatggctgactaaactatgatgaaagatttgagatatcaaaaatgggctgggtgcagctggcgtatgcctataatcccagcactctggcaggccaaggtgggtggatcacttgagcccaggagttcaagaccactctgggcaacatggcaaaacccagtctctacaaaaaatacaaaaattagctggacatggtggtgtgtgcctgtagtcccagctacttgggaggctgaggtaggagaatcatctgattctgggaagtccagggtgcaatgagccatgatcacaccactgtactcccgcctgagagacagagtgagaacctgtctcaaaaaaaaaaaaggcatcaaaaatggctaaaagaaaatcttaaacaaaccatgagttaacagattaaaaaggtgttcttgtttgttttttgagacacagtcttcctgggctgcccaagctggagtgcagtagtacaatcatggctcactgcagccttgaactcctaggctcaagtgatcctcctgcctcagcctcccaaataactgggactataggtgtatcacgacacacagccatttttttttcttagtagagatgaggtctcctgatgttgcccaggctgggctcgaactcctggtctcaagaggatcccgccttggccttccaaagtgctgggattacaggtgtgagccaaaaaaggtgtggggccaaaaaagggtttttttattttttggttttttttttctgttgttagaggtggaggtggtaatggtttctgttttggagggagaagaggtagtggtggtaatggtttcttcttgggaaggagtattaaggtttacagtgtttaccattttatttaacaatattctactacagaaactgaaacattttagatgttaataaaacatctaaaatcatactatgatttacttctccaaagtacaaattacatcacaagtaagcctccatgcaatgacatttttatctttatggagcatcatcaatatcagttaaataaattagtgcaaattgttcctaaggagaagtttagtttccactttaccattaaaagccaagtgcctatgatgcagatgaatgcattgtacaatatatttcaatcaagtcacagactcacttccccactatccatgaaatataacaaaggactaagaaacattaaaaaataacgtatcaaacttcccacaaaccaaaagacaggaagctactgaataatctgacacttggattacattttcattatcattaaaatgtagcaaaggggccgggcacggaggctcacgcctgtaatcctatcactttgggaggccaagacaggcagatcacttgaggtcaggagttcgaaaccagcctggccaacatgataaaaccggtctctactaaaaatacaaaaacttaaccaggcatggtggcacacgcctgtaatcccagctacttgggaggctgaggccggagactcacttgaacccgaggggcgaaggctgcagtaagccaacatcgcaccactgcactctagcctgggcgacacagcgagactctgtctcaaaaaaaaaaaaaaggtagcaaaggaaaaaaaaaaaataggtcagtgtttagaaaggatacaactatatcacgtcttttacttattttacattttgtattggtctagaagttgaaaatacgtgcccaaaacaactatacaacttgagcaatgattttaaaacaaatatgacactttatattagaagcagcaactatttattcagaaacatatactattagttacatttaaaatttatcttgttagaatacactgtttccaaatcaacagtccttacaaaatatggaacatatacttcagtattatttagctttacttttgtaatagtggccaaggtggccgggtggggtggctcacgcctgtaatcccagcactctgggaggccgaggtgggcagatcacaaggtcaggagttcgagaccagcctggccaatatggcgaaaccccgtttctactaaaaatacaaaaattaggtgggtgtggtgacgtgtgcctgtaatcccagccacctgggaggctgaggcatgagaatcgctgaatccagggaggtagaggttgcagtgagccaaaatcgtgccactgcactccagcctgggtgacagagtgagactccatctcaaaaaaagaaaaaaaaaaatagtggccaaggtggattttgtactctgaatataaactatatagtttatactatacatatgtctacttataaactaggcactactgcttcaatatattaaaaaaattattctagaagatagtttatcgtactcagggttccccccacctatagctgcagaccaataccactcggtagcctgttgggaaccaggccacacagcaggtgagcggcaggcaagccagcattaacctgagctcggcctcctctagatcagcagcggcattagattctcatagaagcacaaaccctattgtgaactgcacaagcaagggacctaggctgcatgcttcttatgagaatctaactaacctaactaatgcctgatgatctaaggtggaagagtttcacccgaaaaccatccactccgtgctccccctggggtctgtggaaaaaactctcttccacaaaactagtccctggtgccaaaaagtttggagaccactaacataaactacaaggttttgttaaaaaaaaaaaaaaaaaaaatgtagccaatgtcccttgagggttaatatcaaatatcttagaataggtaacagtctaatatgaatttaactgtgaacataatgaagttaattctacactatctaaaaaactgtttcacttaacatgcatctaattcatcaaactgggtgggtttctctctcttttttttttgagacagagtttccctctgttacccaggcttagtgttacccaggcttaagtgcagtggcgccatctcaactcactgcagtcttgacctccggagctcaacctgatccttccacctcagcctcccgattagctgggatcacacaagaatgtgccatcacacctggctaatttttgtattttttttagggtcagggtctcactatgttgtccaggctggtcttgaacgccttacctcgagtgatccacctgcctcagcctcccaaagtgctgggattagaggtgtgagccaccaagacccaccttaaaacaagttctttgaaaacatatttgctacgtaatagttatgagctttttaaaaaatttcttctaatgtaattaaattctggtaatcagattttcagaagaaatatgttaaaatgctggttaagtgggccaggtgcagtggctcacgcctgtaatcccagcattttgggaggccgaggcaggtgcatcaggaggtcaggagatcgagaccatcctggctaccacacagtgaaaccccatgtctgctaaaaatacaaaaaaaaaaaaaaaaaattagccaggtgtggtggcgggcgcctgtagtcccagcttcttgggaggctgaggcaggagaatcgcttgaacccaggaggcggagcttgcagtgagctgagatcacgccactgcactccagcctgggtgacagagcaagactccgtctcaaaaaaaataaaataaaataaaaataaataaaataaaatgctggttaagtgaccagaggttttatttcttgggtttttttttaaatcatcatggaattaaacacacatgaagaaatctgttgaaacccctcaaacttgcaatgctatacccgaatcacagtgttctttcagagacttttcaaattatacaaatatttcaaaatgctgagttactctactatagctaataaaactacttaaactaagtggaaaaccttgagaactaaagggggaggggatattatttattctcattactcttaaatcaaccaacttccaaatccagaatataaaacttttatgattatttgttctttccctgtttacaaacctagttctgatttcattattaaaaatataggccgggcacggtggctcatgccggtaatcctagcactttgggaggccaaggtagacagatcacgaggtcagcaattcaagaccagcctgaccaacatggtgaaaccccgtctctactaaaaacacaaaaaaattagctgggcatagtggctggcacctgtaatcccagctactcgggaggctgaggcagaagaatggcgtgaacccaggaggcggagcttgcactgagtcaagatcgcgccctcgcactccagcttgggcgacggaggaagaccctgtctcaaaaaaaaaaaaaaaaattagccaggtgtggaagcacacccctgtaatcccagctactcaggaggctgaggcagcagaatcgcttgaacctgggaggtggaggctgcagtgagccgagacagcgccactgcactccagcctgggcgacagagcaagactccatctcaaataaaataaaattttttttaagttttaatttatatatattatattataaatattatatataatgtataatttttatatatgagattatgtatatatgtatatgtatatgagatgtatatataatatatacatctcagccgggcccagtgactcacgcctataatcccagcattttgggaggttgaggtaggtggatcacttgaacccaggagctcgaggtcagcctgggcaacatcgagagacgccgtctctacaaaaaataaaagataaaaaaattagctggtggtgatggcacatccccacggccccagctacttgggaggctgaggtggaaggatcactggggttggaaggtcgaggctgcagtgagccaagatctcactcctgcacttcagcctggatgacagagcgagaccaagtctcaaaaaaaatatatatatggtgtgtgtatatatgtatatgtgtgtatatgtgtgcatacacacacaattctctataactagtgctgtcatacttaatgctttaataaggttaaatacataataaatacaatagttcattttgtctttaacagtacaatccaagtcaagtcatccttccaaaccagatacaaaaatatcctatgaaaagaaacaaaaactttttatccttaggatattttggggttctggccttttgttgtgccagatataataccacttgataagactttcagcttcatcccatcccatcctgcaacaatgttttcagtagggcgggatccgtggctcccaatcaagtccgacaacctgatctcatggcagggcccacacaagaaaaaaaagagcattttatttcgtgcaacttttatggcccagagaatctctgaccccccaccccctcaacacacaataatcagttgatctccctctccctccctctctcccacctccacaccatctatgagaaagaggagggggaagaaggtggaagaaaaggcacgagtagagaaagtagatccgacgtaaagcaggcacctaaaaaaaggtgggatggatttctccaaagcccagatcagggactctgctacagccagccagtggagaatgcctctaatgttaacgctttagtaaccacttacaagaacttcccctgtctactgcttaatttcaaataacccaacaggtccatttaattactttgtattatttaaagaaatctaggatttctttaaataataaaagggaaacgaacgcgttttaacatcattttgcatcacaatgttaaaatcttgggttaactccctcagtaaatctctaaatcctttccaatctactatctctggccaggaagtcaaaactgaaatattaaccaactaaaatgatcttcattctttggtcaattttgcagagcaaaaaatttaaataaataaataaatagatcttcaatgtgtatcaaggatgtcctacttgggcctcactctcccaaacagagcctattttcttccatttaacaaaggaaaattctcatttaaacaagtctaatgaagatgttgcaacctggccaagagcggtggctcatgcctgtaatcccagcagtttaggaggccaaggcaggctgatcacttgaggcaagagtttgagaccagtctggccaacatggtgaaacccgatctctactaaaaatccaaaaattagccgggcatcgtggcaggaacctgtaatcccagctactcaggaggctgaggcaggagaatggcttgaacccgggaggcggaggttgcagtgagctgagatcctgccactgcactccagcctgggcgacagagcaagactccctctcaaaaaaaaatttttttaatgttgcaaccaatttttcttcctcatatttatagatgtttatcatgttttttcttaaaagttttttaaaccaccttttccaaacctcaaaacaagcatctataattatagacaattattctcctggctccgtaaacaattctatttttccttctccaactttctaatcctctcatgaagctggccaaatgtattctactcctgacaccaaacaacagaaaaagaaacaacgtaactgcagtctacttcttttgttttaataaacaaataaactagcttaaatgcacagtggtcttggatcacataagaatttcaaaataaatgatttaaacactttaaatattgtggtgggggggatggtgctggtaaataagggtcaagttctgactttcttattgaggccaaggtcaagaaattacttttttcagatctataaaatcttaccaactcagaatcctgattatagattatcatctcctactcaatactttccaaatctacaatgatataggaatcccactaaaattcagaataattaaaaggagttaagatttaagacataaccaaaaaccagcccctctacaaggcagttgactgtacagttcatgcttgtatacagatggacagactaagaacaaactctacacttctgagaaaaaaaacaaaactaaactaacaatgtaaatctattcattcattataacaatttcttttttcggagacagggtctcactttgtccaggctggagtgcagtggtgcgattttacctcactgcagcctcgacctcctgggttcacgtcatcttcccacctcagcctcccgagtagctgggactactaacgcgggccaccatagctggataatttacgtattttttgtagagacagggttttgttatgctgcccagactagttgagctcctgagctgaagcaatccgcctgcctcagcctcctaaagtgctaagattacaggtgtaagccactgcgcccagccacaaaatttttaaatatcattccaaagaaccatctataatgaaatgtgaaattatgttaaatacatatgtttagaagatacaatgcaactttctagtttttatttccactgtaactaacttcaactatgaataaaattctacataagtttccatctcaggatttttgttctctttaaaattacaaaaactggccgggcatggtggctcacgcctgtaatcccagcactttgggaggccgaggcaggtggatcacctgaggtcaggagttcgagaccagcctagccaacatagcaaaaccccatctatactaaaaatacaaaaattagccaggtgtggtggcgggcgcctgtaatcccagctacttgggaggctgaggcaggaaaatcgcttgaacccaggaggcggaggttgcagtgagccgagatcgcaccactgcactccagtccgggtgacaagagcaaaactccgtctcaaaaaaaaaaaaaaatttacaaaagtcatttagaaaatgtatgaggccagacgcgatggctcatgcctgtaatcccaactctctgggaggccaaggcgggcggaccactaggtcagaaattcgagaccagcctgaccaacatggtgaaaccctgtctctactaaaaatacaaaatttagctgggcgtggtgtcgcacgcctgtgatcccagctactcaggagactgaggcaggagaattgcttgaacccaggaggcagaggttgcagtgagctaatactgtgccactgcactccagcctgggcgacatagtgagactctgtttcaaaaaaaaaaaaaaatgcatatgaaacacaaaaagctgggtgtggtggctggctcacacctgtaatcccagcattttgggaggccaagggggtgcggatcacctgaggtcaggagttcgagaccagcctgaccaacatggagaaaccccatctctactaaaaatacaaattagccgggcatggtggcgcatgcatgtaatcccagctactcaggaggctgaggcaggagtatcgtttgaacctgggaggcgaaggttgccatgagccgagattgtgccatcacactccagcctgggcaacaagcacgaaactctgtctcaaaaaaagaaagaaacacacagagttgccaatgtgaaaactactcaataagatttaataaaaatactgtatttggaaaaaatctttttttttttttagctgggattacaggcgcccggcatcatgcctggctcatttttgtatttttagtagggaagaggtttcaccatgttggtcaggccgatctcaaattctagacctcaggtgatccacccacctcagcatcccaaagtgctgggattacaggcgtgagccactgcacctggccttaactatttttcattaaggtaatgaaataagttaacttctcaatactttctttctttttttttttctttttgagacagggtcttgctctgctaccaggctagagtgcagtggcatgatcacagctcactacagcctcaatctccaaggctcaagcgatcctccctcctcagtctcccaaacagctgaggcaacaggtgcataccacatgcagctaattttttatttttttgtagagacaggatctcaccattttgcccagactgattttgaaatcctgagctcaagctatcagcctgcctcagcctcaagtgctgggattacaggtgatggcatccggccttcaatattttctggatgaaagagaggacttattactagtcctagattattatgaaaaacagcaatatcatgattaaaattttgttcctcctcccagtactgtgttctattaattagataggaaataggaatgaacaaaaatagacattaaatcaaatgattttactttctaaaagtcaaaaattctaatgctttgtttacctatctacaaatatttatcttactacttctataaataattgaataaaatcttaaatgaactaaaagaaataatgggacttttcactacacaaaagataattacctatacaatgaaatgaggtgaaattcttagagcaaatatgtcatacaacaagcttaaattaatgatacgaaacagttagaatgcccccaccccaataaaccatggacaaaacacgactgggcaattcgcaagaaatacaagtaataaaattcaaaaaaaggctgacgcggtggctcatgcctgtaatcccaacgctttgggaggccgaggcgggtggatcatgagatcaggtgctcgagaccagcctggccaacatagtgaaaacccatttctactaaaaatacaaaaaaatagctgggcgtggtggtggatgcctgtaatcccagctacttgggaggctgaggcaggagaactgcttgaacctgggacgcgaaggttgcagtaagccaagatcgtgccacggcactccagcctgggcaacagtgtaagactcaggtctcaaagaaaaaagaaaaagaaattcaaaatattcattagtcctactaatcaagtaagtaaaagcttagaactactttttttctgttgttaagataaagattttaatatatcatacatgacaaaggtttgataaaactagacctatcacacattgctaatgacattacaaattgatgcaacctttttagggagtggcatttcaaaactttaataaaaataagagatcagggctgggcatggtggcttatgcctgtaatccaagcattctgggaggccaaggcaggggagatcacttgaggtcaggagttcaagaccagcctggccaacatggcgaaaccctgtatttttagtattctactaaaaatacaaaaattagtcaggcgtaggccaggcgcgatggctcacacctgtaatcccagcactttgggaggccgaggcgggcagatcacgaggttaggagatcgagaccatcctagctaacacggtgaaaccccatctctattaaaactacaaaaaattagccgggcatggtggcaggcacctgtagtcccagctactcgggagggaggctgaggcaggagaatggcgtgaacccaggaggcggagtttgcagtgagccgagatcacgccattacactccagcctgggcgacagagcaagactcatctcaaaaaaaaacaaacaacaacaacaaaaaattagccaggcatggtagcgcgcctgtaatcccagctacttgggaggctaagacaggagaaccgcttgatctcaggaggcggaggttgcagtaagcggagatcatgccactgcactccagcctgggtgacagaacaagactctgtatcaaaaaaaaaaaaaaaattcaatgtaatttaaaaaaataagagatcaagccgggcacggtggctcacacctgtaatcccaggactttgggaggctaaagcaggcaggtcacttgagacaggagttcaagactagcctggccaacatggtaaaccttgtctctactaaaatcaaaaaattagccaggcatggtggcacacgcctgtaatcccagctattcagggcgctgacacatgagaatcccttgaacctgggaggcagaggttgtggagagccgagatggcaccactgcactctagcctgggtgacacagtgagacatcatctcaaaaaaaaaaaaaaaaaaaagagtttatatttatctcaaaaaaagagtttatatttattgcttgctaaggcatcaaatataagaaggaaaaaattttaaaaagttcgtatttactaagaacttactaagtaataggcacagctcactgcaaccacttcctcccaggttcaagcgactctcctgccacagcctcccaagtagctgggattacaggtgcccaccaccatgtctggctaatttttgtatttttactagagatgggtttcaccatgttggtcaggctggtctcgaactcctgacctcaggtgatccatccacctcggcctcccaaagtgctagaattacaggcatgagccactgcacctggcctctagcggctttcttaacacatataccctctttaaatcttttaataatcctgtgacaaagatgttattatcatccctattttataggtaacaaacagatacagattgaacagcttatacaaagtccaacaactagaaagtgataagaccagaatttgacaataagcaaatagacattagagcctatatgcttctgaatatctatgaagaatcaaaaaatgcttttttgttgttgttgttgttgagacggagtcttgctctgtcgcccaggctggagtgtagtggcatgatctcggctcactgcaagctccgcctcctgggttcacgccatcctcctgcttcaacctcctgagtagctgggactagaggcgcctgccaccacacccagctaattttttgtatcttttagtagagacggggtttcaccacgttagccaggatggtctcaatctcttcacctcgtcatccacccacctcggcctcccaaagtgctgggattacaggcatgagccaccgcgcccaccctctttcttttaaaaaaaaaaaaaaaaaaaaagatggagtctcactctgtcacctaggctggagtgaagtggcacaatctcggctcactgcaacctttgcctcgatactccttccttagcttcccaagtagctgggactacaggtgtgcgccaccacgcccagctaatttttgtatcttagtagagatggggattcaccatgttggccaggctggtgtcaaactcctgacctcagatgatccacccacctcagcctcccaaagtgctgggattacaggcgtgagccaccatgcccggccaaatgcttattttttaacctaattatcctgcctatggtaatctgtcctataaaaataaccaaaatatgaaaaaggctttatctacaaaaaggtcagccagagcattacacatagtaacaaaaggcagtagggtgagaagaggaaaaggggagacagctgtatggttacataaattatagtgtggttactcagttttttgttgttgttttgagacagagtctcgctctgtcgcccaggctggagtgcaatggtgtggtcttggctcactgcaacctccacctcccggattccagcgattctcctgcctcagcctcctgagcagctgaagactacaggcgcatgccaccacacctggctaatttttgtatttttagtacagagggggtttcactatgttggccaggctggtctcgaactcctgaccttgtgatatgcctgcctcagcctcccaaagggctgggattacagtcgtgagcgacagcactcagccctcagttttactcaatggaaaattaagcacccttcaaaaatgttataaaagattaacaatacggaaattttcttttacatgttacaagggaaagtaggttacaaaactctaaatgtacataagtagtatcacaaaaaaaaaaaaactgtgtatatgaaaaaagtttgaaagagaataggtcaggctgggtgtggtagctgatgtctataatttcggcactttgaaaggccaaggtgggaggatcacttgagcctaggagtttgagaccagcctgggtgacatagtgagacgactgtccctacataaaaagatttgtttttcatttaaaagaaaaaaaatagactgggcatggtggctcatgtctgtaatcccagcattttgggaggccaaggcaggtggatcacaaggtcaggagtttgagaccagcctggccaacatggtggaagcccatctctactaaaaatacaaaaaattagccgggcatggtggcagacgcctgtaatcccagctactcaggaggctgaggcaggagaatcacttgaactcgggaggcggagattgcagtgagccgagatcatgccactgggctccagcctgggcaacagagcgagactctgtctccaaaaaaaaaagtgggggaaagaaaacatttacatttataacaacatcaaaaacaatgaaatacttaggaatcaatttaacaaaaaaagtacaagacctgtgcattgaaaattataaaatactacaaacaaattaaaggagatcagaaattatacttcatttgatacttaatcacatgcaaaaaatcattagttccagttttacagttgttgccggttatttttctaacacagatacaatgtcatacctctgtttaacatcttcaatggctccctattgtttacagttaatattcaaaatgcccaatttactttcccttcctcatttcctcccatattggactgtagtctcttaaaaagcaaaggtcagggtcagacacacctggattcaaatcctgactcaatcacttacaagctatataaaaattcatctttcatttgtaaaacgtactaatgattcaaccccatgtgatcagtaattatcaaaaaggtaacttctggtaagcactagtagtgcctaacacataatagccaggtactagtttctcactcccctttttctcttcggtaaagtctgttttcatttttaaacactcaacaaagatgtcttctttcttcagttcctctgagataagttcttccttctctaagcttcctcagcactttctgaaatctattgtaaaatgtgtcatttgcattatactttgcactgagttaccagaaattgaaggtagggatcttgccttattttggtctctccactgtataatacacagcagattctcagtatttgattttgcctaacatcctccttgggtgattaacagagaacaaataggaaaagcaaatctgactaagaataaaccatgcttcagaaatgtactttgaaaggaagagattttaagtcacctataatctaacacccacaccgatctgtgatgaacacatagcatgagcaagaaatgaacctttgtgactgatgccactaagaattgggatcctttgtcaccgtaacatattctgtatattctgatatacacattaaaggagtttagtatttatctgcatcatccctatctccagtgtttggaatgttctgcacaaagcgggaacttctgcacagcaaaagagattatcaacagagtaaacagacaacctacagaacgggagaaaatatctgcaaactatgcattcaacaaaggcctggcctggctcagtggctcacacctgtaatcccagaactttgggaggccgaggtgggtggatcacaaggtcaggagatcgagaccattctggccaacatggtgaaaccccatctctactaaaaatacaaaaattagctgggtgcggtggtgcacgcctgtagtcccagctactcgggaagctgaggcaggagaattgcttgaacccgggaggcacaggttgcagtgagctgagatcgcaccactgcactccagactgtaacagaaagagactccatctcaaaaaaaaaaaggcctaatatacagaatctgtaaggaacttaaatcaacaagcaaaaaactagcattaggagatatacttaatgtaaatgacaagttaatgggtgcagcacaccaacatggcaccttgtatacatatgtaacaaacctgcaagttgtgcacatgtaccctagaatttaaagtataataaaaaaatagtttataataaaaaaaaaacaagcaaaaaacaaccccatttaaaaatgggcaaagggcatgaacagacacttctcaaaagaagacatatgtggccaacaagcatatgaaaaaatgctcaacatcacttatcattagagaaatgcaaatcaaaaccacaatgagataccatctcacacaagtcagaatggctatgattaaaaagtcacacacaaaaaaaacatgttggcaaggttgtagagaaaagggaaggcttatacactgctagtgggaatgttaattagttcagccactgtcaaaagcactttggggatttctcaaagaactgagaactaccattcaatccaggtatcccattactggatatatacccaaattaatagaaatcgttctaccataaagacacacatacacatatgttcatcacaggactttgcacaacagcaaagacatggaatcaacctaactgcccatcaacagcggactggataaagaaaacatggtacatatacgagacagaatactgtgcagccataaaaaaagaatgaaatgatcctttgcaacagcatggatgcagttggaggccattattcgtaagcgaattaattaacagaaagccaaatactgtgtgttctaacttccaagtgggagctaaacactaagtacatgtggacacagaggggaccaagagacaccaaggcttactcgagggtggaggctgggaggaagttgaggatccaaaaactacctactgggtactatgctcactatctgagtgacaaaatgatttgtgctctaagcctcagcgacacgcaatgtgcccatgttaacaaatctgtgcatgtaacccctgaacctaaaataaaagctggaaggaaaaaaaacaagtgggaactcaggtttattagaaaactttaaaatatggaatgaatgtaggacatttttaaagagaatagtcaaaggttagcagaataaccaaatgttttcaatgaaaagattacaaaagttgaagtaaccacatttttaaaaagcacagcgttagcatataaatgggagcatgcttttactctcctcttcacccaaaatacatacttctactacttcctcaccatgctgaggtcaaaaactggaggcttagggctgggcgcagtggctcacacctgtaatcccagcactttgggaggacaaggcaagtggatcacctgaggtcagtatttcgagaccagcctggccaacacggcaaaacccagtctctactaaaaaaaaaaaaaaaaaaaaattagccaggcgtggtggcagatgcctgtaatcacagctactagggaggctgaggcacgagaatcgcttgaacccaggaggcggaggttgcagtgagccaagatcgcatcactgcactccagccacgcgacagagcaagactctgtctcaaaaagaaaaaaaaagaaaaccctgggggctcaggattcaacaaagcattgttgaaagcagtcactaccaatcaaccgggcctcaacatgaaattatctgccatcgcaagaacttcagtatcataattctcacacatgagaaaattaggcctatggtgataaaccaattgctcaaagtggtaaagactatttactagctatttctgtaatatttattcccaccatcagtaaccagactttgaacctattctaagtagcaaggtactcatctaaaaaaactacattcccaaccaggcgcagtggctcacgcctgtaatctcagcactttggaaggccaaggcaggcagatcacgaggtcaggagatcaagatcaacctggctaacacggtgaaaccccgtctctaataaaaatacaaaaaattagccaggcatggtggcctgtagtcccagctactcaggaggtggaggcaggagaatggcatgaacccgggaggcggagcttacagtgagccaagatcacaccaatgcactccagcctgggcaacagagcgagactctcatctcaaaaaaaaaaaaagaaaaaaagaaaaaaaaactacattcccagccgggtgcggtggctcacgcctgtaattccaaaactttgggaggccaaagcaggtggatcaccagaggtcaggagttcgtaccaacctgaccaacatggtgaaaccctgtctctactaaaaatacaaaaattagccaggcttggtggtgcatgcctgtaatcccagctacttgggaggctaaggcaggagaatcgcttgaactcgggaggcggaggttgcagtgagccaaaatcatgtcattgcactccagcctgcatgacagagcgagactctgtctcagaaaacaaacaaactacattcccagcctcccttgcagctacaggtagccatgtgaactctgtgatagttctagccaattatatgtaagagaaaacatacaatatttcttcaaaggaggaggctgtgtgcccttggactcctttctgtattttgcttcatgggacatgcatgtaatgtaattgggactttagtagccatcaaggaatcttagggcaaaggccacaacctagaaatgtctgagaagttagataaagggagacactcctgatgactttgcagtgtagagggacaataccagcctcagtacctaccctccagattttgaagtgaaacagaaataaacactcctgttcaagtcattattattacggggttttcaatcacataaagacaaacctagtccttactgatatacccggctgttaagaattggcccagaaatagaaatcagttcttctgtcaagagtccaggatgctcaaatatataaagatctctgtacaagtcaacaaaaataaataaataaataaactatatcctttttagggttgatattcataattgttttatctttctattctgtatgacctaactatagcccaatctacactgtgacaattccatttttaaatactatttaaagtcctcaataataaaaatctgtatttcaaaatactttagaaaaataaagggtaaggttaaggagaaacttcatttaactatttcagtaaaagaggatggaaaataatgatttttatcactcgtatcccaaatgcattttttttttctgagaccgggtattgttctgtcacccaggctgggtggggtgcagttgcaggatcatagctcactgcagcctccaactcctctgctcaagtgatcctcccacctcaacctcctaagtagctgggactaaaggcatgtactaccacacccagctccaaatactctttgttcttagcgtcccttaattcagaaaactatctgcttccagcaaaacagattaaaacaaccagcattttacttatttatgatttcgtaacctggactgagcttagctaggtggttcctctgttaatcttttttttgtgtgtgagagagagaaacaaggtttcactctgtcgcccaggcttgagtgcaatggcaagataatggttcactgcagcctcaccctcctgggcttgaccaatcctcccacctcagcctcctaagtagctaggactacagagacatgccaccacactcagctaatttctgtatttttttgtagagacagtgtcttgctatattgcccgggctggtcttgaactcctgggctcaagtgttccacatgccttggcctcccagagtgctgggactgcacagtcataagcccccacgccggccccttcgctaatcttactaatcacttttgtgtctgtattcaacaggcaagtcaactaagggctgaaggcagctaggacactgagatagttaagcctccctctttccatatagtcctggaatctcttcctctccacatcatctctccagcaaggtatgacagcttcttgcacggcagcaactcagagctcccaagagtacaaaagtagaagctgcctgacatgctcaaggcttgtacccaaaaatagcaaagtgtcatttttgctatgttctactggttaaagtgagtcacagggctaggcgagatacaaagagagatgactatacaatagcatgaatacccataggcatgatttactatgggtctacaccaatacagtagactaccatctcctttatttactgtaaaagtaacaccttaatatatgacttctagtattccataatctctctggggctcagttatctataaaatgaggggttagactcaatcttcttgaattctcatctattaatagttctaatattctacaactctataagtatgaaagtctaatataagaaacacttagggccaggcacagtggctcacaccagtaatccctgcactttggaaggccaaggtgggtggatcacctgaggtcagaagttcgagaccagcctggccaacatggtgaaaccccatctccattaaaaatagaaaaattagccaggcgtggtggaggggcgcctgtactctcagctactccggggtctgaggaaggagaatcgctggaaccagggaggcataggttgcagtaagccgagatcgtgccactgcactccagccagggtgacaagagcgaaactccgtctcaaaaacaaacaaacacttggccatactgaccaaacacttcaactatggtagaacaattcaatgagaactttaagaatatggttatgtttcattttgtcattttatattcaactatgtgcttattccaaatgtggtccatatgactagaatcccaaagatcaggaaatcaaggaaattctttttttgctaggctccactaaaagaacaccaccacacagacttcactgagaccatcaagtatgctgcttctaatgtaaatcgattacaataaggtgtaaagatttaaagtgaccaaggataaaagatgtaagaaatcattttaaaaccacctaaaacaagtctcactgagggaggcctactaataaaaccctagccagtagagttataatatgtaaaaatctactctaacaacatttaaaagtttgagcaataaaaaactttggaataatattactacatatacaactcctagggaattgctttgactgtttttcgtgtattgctcataatgaaaaacatttcatagagatttctgctgacctagctttttaaaaatctttcttctatatattggggacatctgcgtacaaagaaaatctttgccaccccactatccccgcctccaataacaactgcattattttatgtcatagtttttttttttttttttttttttgggagatagggtctcgctctgtcacccaggctggagtgcagtggcatgatcacagctcactgtagcctccaactcctgggctcaagcaatcctcccatctcagcctcccaagtaactggagctacaagtgcataccaccgcatccagctatttttaattttttgtagagatggggatctcactatgttgcccaggctggtctctaacgcctagacttaagcaatcctcccacctttgcttcccaaagcactgggattacaggtgtgagccaacatacccagccttatatcatggcatttttggagtgagtttggtttctaatcacttctgtctctaaatagtttataacaggcaactgattgataattgatgattagtggcaatgacagtaacaacagtagttaaatccttacaacagcacctcttaataggacttagtctatgccagaaactgttctaaattctacacatatatataaattcataacaatcctaaattaggtgtattattacgtcctctctacaggtgaggcaaccatagcacaaaaaatttaagtaacttgcccaaggtcaaacagctaatatgtagtacaacctagacttgaatccagaaggtctaggctctataatcagtgatgcccccagaatttggttttctcatttgtcaaatgatttaccatttctgaagtattaagcttttttctttttttaaatgcataaatgtatactgaaagaatatactccccagagtttttttttgttttgttttgttttgtttttgagacagagtctcactctgtcgcccaggctggagtgcaatggcacgatttcagctcactgcaaactctgccacccaggttcaagcaattctcctgcctcagcctcccgagtagctgggattacaggcgcctgccaccatgactggctaatttttgtagttttagtagagacggggtttcaccatcttggccaggctggtcttgaactcctgacctcgtgactcaccctcctggcctcccaaagtgctgggattacaggcgttagccactgcgcccggcccccagagtattaatatttattatgtattcttcccaatctttttatatgcacaaaatatacacacagtttgggtttatgtgcttttcacaaaataaagttactgctaaacttactgctttacaacttttggaaaggtttttctctagttcaacaatgtatcatagacattctcccacttcagggcccacagatctatctctatgtcttgatttaaaactgcatggtagtccattgatgcatattttgttgttgccaacttttctctactactaatactgctgccatgagcatcttgtatgtatatgttgtccatttgtcatgagaatatattctgatttcctttcttgtttttccgggtataactggtcccctatctcctaagggcaacaaagcatcctaatcctttactaattcccatacgccatattctcagtgattacatgttaagtcacatctttaaatacttatcctaatcgattcctcaactccagtcctacttccccgaatgcttagcaggcatccaatctatttggatgcctgctacaacatctatgccagaaactgccgaattcctcctttgcagtgactggaatcttcctccccattcgcactaccaacattctatgctttggcttgatctctcacactacaactattgtaacagcctattatctctgcctccaggtaactcctgtctccatattattaccacagtgtttttttaataataggcatcattaaatcaccaagtatttgagtgcctacattcaaatgcataaatgctaaacagaatacaaagtaatttagtaaggttcctatcctcaagaatactgtaaatacctgctttgaaaactttcatttaaaaaataaaataactgggcataaagcagagattgagacctgtagtcccctggtggtccgcagattaaacctagcctacaaagtataggcgcaaataccgttttagattctaattaatgaaaaacacttaaaatccaagtttaaaaatcataaaaagggctgggtgcggtggctcatgcctgtaatcccatcattttgggaggctgaggcaggtggatcacctgaggtcaggagttcgagaccagcctggccaacatggtgaaaccccgtctctactaaaaatacaaaaaaaaaaaaaaaaaaaaaaactagccgggcatggtggtgggtgcctgtaatcctggctactcaggaggctaaggaaggagaatcacttgtacccgggaggcagaggttgcagtgagccgagatcacaccattgcactctagcctgggcaacaagagtaaaactccatctcaaaaaagaaaaaaaaaaatcataaaaatccaaatttccgccctcttgaaaaatctagaaacagcatctcaaatagcaaccatcagccagaattctgtatcagtttcaccttaagcagggcataaggactcctagacttccccaaggctgttattatttcccattttctccccaacccaaggtctaaagtgtcagttgtcattcagattcttagaagcagcctactgttcatttaaattgcttacctgctccctgtaaacagtttataactcctggactacaggataaagcccaaactcatgagtctggcattcaagaactatcacagcttggcctcaccactacacacagcctctgttctagtcacacagtcagaagccaccccaccttttacacctccttccctcaataatttcattcacattgctccctcacacactcattttcttgtcattctacttggctaaatcccaccaatccttcaaggtctaattcaaatactacttcctccaaatctttgagcacccctctaggccacaataaatcttccagggttgactgttcatcccaggacatatttagcactttgtagctctttaaataacatgtaccaaatgaaagatctaaaaagttacatagaagtatagaaaacttaagacttgttaaacaattttacacttgtagatcatatgtagttactgccatcacaaaattaacagcagaaacaaagtgaaacaattttccttttacctgaggctttttctagaatattacaaagtgcaaaaagagctgtgtcatttgtttctctcaacttgtgctcttaagtccttcaaattctgcaaataaagggatcaacacttccaattataaatccaagattggtctattacttttttttttttctttttgagacagagtctcactctgtcgcccaggctggtgtgcaatagcatgatctcagctcactgcaacctctgcctcctgggttcaagcgattctcctgcctcagcctcccgagtcactgggactataggtgcctgccaccacgcccagctaatttttgtatttttggtagagacggggtttcaccatattggccaggctggtctcccactcctgaccttgtgatccgcccacctcagcctcccaaagtgctgggattacaggtgtgagccaccgtgcccagcctttctattacattttcacagataaccaccagcatatatctacaagcaatagctataataaaaaaagaaataatctcagccgggcgtggtggctcacgtctgtaatcccagcactttgggagtgccgaggcaggcagatcacctgaggtcaggagtctgagaccagcctggccaacatggtgaacacccatctctactaaaaacacaaaaattagctgggtgtggtggcatgcgcctgtaatcccagctttttgggaggctgagtcaggcgaatcgcttgaatccggagggcggcagccacagtgagccaggatcacgccactgcactccagcctaggcaagagagtgagactgtctcaaaaaaaagaaaaaaaaaaaaaaacagaaatcatctctattctacttcgtaacttttgccacttatcctgccaacaagttctcaaaataaccactgtagcacaaacatgataaagaaaatttttaaagagaaaaggaagagattaatcagctttctgaaattaaaagataaaaatggaccaaaacaatatagaaaaaaaaaagtaaaggcaaacacaaactcacacgctgactgtaaagtttattccatggcagctaaaagttgtttggcccaaacatctcacagattaaaaactaaatcacaacctaacgagggtatctaacacgtccccaccaggcaagagtgcagagagaccatctaatgttcctatttatttagagagtcttgctctgtcacctgactagagtgtagtggtgtgatgtccgttcactgcagcctcaacctccaagcctcacacaatcttctctcagctcagtctccagagtagttgggactacaggtgcctaccaccacacccagctaatttttttgtagagacaaggcctcactttgttgcccaggctggtctcaaactccttttaaatgaggattaagtgatcctcctgactcagtctcccaaaagtgctgggattacatatatcagccaccacacccatccttaatgtcctttataactggaaactgaccaattttcaccttggaaggtcaatgaagtttcacgaagcccctccatcataaacttaaagtgacttaagtttacagagttggacaaccactatctacccagagaaacctgactgtggtctgggaaactttgcagttttgcggaacagaggaatgagatgaagcagtgtggcttgtcacttggcagattaacaacaattctggcattatggaattaactgaaatagtacgaaaatgtaataaatcacaagtgtcagaatgggaaaacaaattgttgtgatacttttatatttccatggaaatccatgtttatcaagtttacatattagtaaccaatatgtaaattggtaagtttacatattagtaactaatatgtaaatttatatattagtaaacaatatataaatttgtataatagactaaaaataacatcttctcaaatattagaaattccctgggccaggtgcggtgtttcatgtctgtaatcccagcactttgggaggcccaggcaggcagatcatgaggtcaagagattgagaccatcctggctaacagggtgaaaccccgtctctactaaaaatacaaaaattagtcaggcatggtagtacgtgcctgcagtcccagctactccagctacttgggaggctgagacaggagaatcacttgaacctgggaggcggaagttgcagcgagccaagatcgcaccactgcactccagcctgggcggcagagcaagactctgtcaaaaaaaaaaaaaaagaaaaaaaacaggttcttattcatgggaatttcaggtcaggttaaacaacaacctcctaacaggtaagagagggtagcaatcctgagtcaacttttcaactgaattaaaacatttcagtgcctattgagtcccagagaccaataatatcaaaaattttatcagatctcttggacaataaattattaagaattgctgtcataaaaattacaaatttgcattatctcaaaaagcatgaataatagtgctgtctctcaactataaacttgttttattaaatggtatatattgtaatgcagtacagttttctatcacttatttcaaattcacagctatgaaaaggagaaattttgttgggggaagggcgttacaaatacagagtagcaacctagccatttttgctggtccttgtaatgacaatcactggttgtgcctaatttttctacaacaataatgcttaaggtggctctctaataatagcaattgccctctgaaaagaaagtggttcagggtataaagagtttactcaaaaaaggccaaggatagtgcttcagaaatcctatacctaccacctgctgcttctgtacaaccacccccatcccccacacccacacccatttctaacatcaactttcatgaactggtaagaaacatagtagagtagaatgtttctttggcttcccaacttggtaatgtgaatttacagtgtaaggatggaaaaaataagaaaaaagcttcagaaaaattttttaacattaacacaaaaataatgagatctttaatatgtgcatattctgacagaggcctgccaatggttaagacctgtgcctctgataaagatgatgaactactccaaattatcaaataatttgatactttttacagttaaggaaaactttcaaatgaatgtaaatttcactgtgccacttgacatttgtacaataggaaacctctatgtatttacttttccaactctaagattaatagcttcagttcaagtttcttgattttaggtagtaaaattttaagatatttatagttaatgtaaaagcagtaactatatagctatgctttttattcatgacaaaatacacaaaaacaatctagctaacactataagacaagaaaatgctttatttacctaattattaaaaatttaaacttgaggaaagtgtaattggtggtgcatgtttttttaagccaaagataaatacataaatccacttcattgtcaaaaggcatcttctcagcggggtgcggtggctcacgcctgtaatcctggcactttgggaggctgaggagagtggattacctgaggtcgggggttcaagaccagcctggccaacatggtgaaaccctgtgtctactaaaaatacaaaaaattagctaggtgcgatggcgcacacctgtaatcccagctactctggaggctgaggaaggagaatcgcttgaatacacgaggcagaggttgcggtgagccgagatcataccactgcactacagcctgggctacagagcaagacttcgtccagaaaaaaaaaaaaaaggcatcttctctacttaatgtaactcactaagttaatgaacatctaagtaacattagcaacttaaaatatctctatgagatttagcaaagaagattaattttcatttctcaggtgaattatttgcaatttcacataatttcactggttacaaacctaatttacactggttacacataagtttcactttcagggtctttactgtccaactacagggtcttttctgcatggattcttatacagtatagagatacacaattcaaaaacctctttgctttccaattcatatgttagtttccatttacatgttgctaaaaacaactggagattccattcccttcaaaagacacaatttcaaaaaaaacgctctaaaaagtttagacccgtcaaatttaccagtagactttaatttcctataaagaaagcagtactagttttcaaatctaaaagaaaaagctctctacagacttacatttgttctaaatatttccaaaagttttgatttttcatagttagattatactgttattcagcagaaattttttatcttctccaaaggctgcctatttcttcatgagattcagaattaaaataataaagtggcaataccctaatcgtccagtgcactcaggagctgcactaatacaaatgagctcatttcaaaagtagggtgtgtgcgagtgtgcgcgtgcgtgtgagtgtgcgcgtgtgcgcgtgcacaagcacgcccttacaggagtatggggtgtggggtgtgacaacatagatctaatctttctggagtaagaattcaaatgcaaatttaaaacaatacttgcaaattaatgttcagtaagagatgaagaaatgctttgcaaatagtgaaatgggaggcaatcaaggtaaaaccccaatatggcttgtcctgagttgctttaaaggatgcaaaaaaaagtggcttacatgtctaaaaattacttaaacctccacttccttctacaaatttcagttaatacagaataagggcattttatacttgccactgtattacaacgcaagtggcataataaataagtcctaactttgtatcacgaacaagctaatgtaataatgtacacacatcctgtacttgcttccctcacgattatcatagctaggtaacagctggcaataaaatatggaggcaagttgaaggccctgaatcattttcatagtaaaaggacagcggggcaagaaaagagcacattcaagtcaagagctcaatgggttcccacaacccagctctgctatgcctcagttcacgctactatttttactacaaatcaccaaacaacaatactattactaagtgaatgcacccgaaccaaagaaacagcctatccataaacgtgctggcttccttcacgtcccagcgcacccttccactcccgacagttcaatgagaatatcatctcacgaaatgagtaagcacacacgccattctacaacttcgagagacattcacagttcttccacggcacacgcgagagccacagaagccgagcagttcgctggcactaaaacggtgtcttaatttacaagcaaagccgtcaaataaccgttctgtaagaagacatttctggtcctctaataagctggggtccagccctactgtacgctcaaaggcaggcgaccctattcccaagccccttacagctaagacttacgagggaagcgacatttacatctgcactctctccgaataagtgctcttggtattctgccttacgaggggacgctggctacgtctccaaaacttaggcaggccgttccccgaagctgggggatcccacaggacttgtgctttcggagcccgggagtgcggtgctgggtgttgggggaggggggaggaagaagtcaaatggcttcctaatatatcatcaaaagaagaaaacacaggtttgggaccaggaaaagttccaggagcaagtcgctgacaaacaaaagctgcactcgcccggccgctttcttctcgcccccagcccgcgccccgagaccacctggcccgggcgttttgacagctccgagagtttcccgagcgccgacggctcggcggttcgcccggagtccgtccggggactacctgggcgcgctccgggcttgttttctcaatgatccagctaggccaagacgcggctacgagaaatttctccaaaagaagagtcgcggagaagacccagtgaaaaggcccgactgaaaagtaaagtgtgcggagccgggcgccggcgggagcccgggcgggcggcgcggagcgggggaggccgggcgcgggcggctaccgaggggcgcggggccggggccgggagccgccaccgcccgcgggcccgccccgcccccaccccgccggggggcgccggggcgcggaggccgcggggcgggcgcccggtgacagctccggcccggcgccgccgctggctcccggcctggctccctcgcactcaacttacttctttctggctctctggaaaggggaagcgccatctttgcgaggccggccccgaggtcttttgtctgcggctgcggggctcggggccggggctccaggctcctcggggggtggtggcggcggctgcggctgctccacgctcttgtcctcctccgacgacatcctagtcaccaggaaagacacatggatcccggtcctcctcctggggggctcccgccgccgcggccgccgccgccgccgctgctgctcgggttcctcctccccggctcagcctctcgcatttcccgcagccccgggagcagcagcaggtaccgggagaggcggcaacatggagcgagcaggacacgcactcacacacatcggcgcgggcgcgcgcacctccgcgcgcaggggccgggcggggggcggcgggcggggcgggcggtgcggggcgggcggggccggcgggtgcgggcgggcggggcagccgggcgggcgggcggcgtgaggggcgccggcccccggggtctccgcccgcggcccctcccccgagccgcccgcggcaggaggagaaaggggcccggcgcggggagggccggccgcggggcccggcgggggcggcgagggggtcgcgcccccggccggccgcccctcccccgcgcgtcaggcccgtcaggcccgggcggcggcggcggcgaagttttgacagctgctccagtggcggcgctgggcgccgggccgcggctcgctcctcacactcgctctctcacacacgctcgctcgctctcccggagcaggggaggaggaagttttgcgggtgtgcttggaccccacacacacgccgcgcgaccgtggccgtcgcgcgaggcccgcgccggggatcccccggggcgacccgcaccacagacctctccaactcgcagccgtcgcgcccacacaccgccgcctcgacggcccccgcccgctcccccacactcggcccctcgcccgccccccgcgcgccgccgctgccactcacgggcctcgctccgcgcatgcgccgctcccgccgcccgcggacgcgccgccgccgctgacctcaccgcccctccccctcccccccgggttccctccccctgtgacgcggcggccgggcccagccgcgactccggctccggctccggctccggctcgggaggtagccaagctgtggacccagagatccgggatcgggatcggggaactgcgggcgagggcgggagggagccgcggacacacgccgaggcggccgcggtcgcccggcgcagcccggcgcgaggagcaaatgtgcgcccgcacggcgagggcagcccgggcttcgctggttctcgccgaggtctttcctcgtagcgcccacactacggggaggaaaaggaatggagtcaacttcgttcgaatccaacgccagttagtttccttattataacgtcattttttttaatccagaaaaggttcataaggatgtaagacgaaaagaacgatgacagctcgagaaataaaacggttagagacaaaataagccaataaaaacccaaccacttgattttaacgttcagtgtgttgtgatgaagaggcaaaaatcgaagtacttctaagccacctctcataatatgtaaaaatggtaaaaagaaaaatggggctagaatccgcctgaaaaatgcactttctcaagaaggacagttacaaatatgggattctggatttctcaggctaatacctaacacttggacgatgatctattctgtgctttccattcactatcgattagtttatgagagtgaaaaaattctagatttgaatggggggaaatagtaagacctatcaaccatttgtgaaggattggggtaaactatcatttaataagcatctactttgggcctagcgttaagaggcacactctcatgttgatttcttttgatcttcgcagtgtagttttagtgtaaggtaaaaaaaaataggctccttttccagcgatgtttgctttcccttctagtagctaggatgttaactttaaactgtgtcttctacttgggcaaaatacacacactttgattcccagagcctattctaaatgaaagcataattttttgaaatggctgaaatgaggaataacgtcagatagtcatttgaataccttcagggtttaatccctgctggctctttcaaatttactaaatttataaccaaaggaaatttgggattgaggaggaggctggcatggtaaatgcaaactagaaattaaaagtgcctgacgattacacatagaaatacaacatatatgtgactagtgataaacatatgatgtgatctagtgaaagtttactcagtacaaatttgaaagcaccctttcttttttcattttcttcagcacattgtactttaaataaagtgtgctttcaaaactggattattgatccaaatatttagctgtgttccgtactgaaattagaataggcacttccacggtgagtttcacatgtacaaaattatacatcaggataatttacttccatacgcttctccagcacttctgagaacttaagtgtcagtggatacaaattgcaagtcactcctgctggagagttcacaagaaacaaagggtactaagagcagaaaagtgagccgagtgaatggaagggtagaaacagaggtttgtgcagggatgcttctggatagatgatgatgcaggtaagtaaactcagcctgaaatctccattcctttggccactatgagcagggagttgggatctgttttaagagagctgatagcagtctccttggcatgaagttatcatgaacagagcaaatcaaatataacccaggatgctgaggaaggattcaaggaatacttattcaacataaataaaggttttccagaggtttttccgtctcagtcatccaaattacacagctctgagaccacagtagcaaaaatctaggaggcagggagctgaggtccttcaaaattatgaaagcaaaaaggcaggagcatctggaaacagtaccaaatacaacagaaaaatattagaatgtgtactttctaataagtatacatgttaaatatgggattttaaatttaggtagatgtgtactaacctgttaaccaatcatctgcaaaggggtgaattacaagggacttttactgtctaaaatatttgaatatttcaaagcacatgtagtaatcatctaatcatatatatatatatatatatgtagtttttaatggggagggaatgagcattgttatctttgacaaagaaaaaccaacatctcagaaaaatataggcaaggaagattctcaaagcatctagcaaacaagtgacagtgaataaaaattcatagtccaatattcattcttactaattgaaggcctataacatgtgattgtctttatttagaatgcacaggttcactactaaatgttgtctctcttgttttcccataaattcctcagggctttttaggaaccaaactttcactgttatagaaggaccactgaaagcttaaattttagatcttagaatttttgtgttcatattgttattattaaagttgcactgtaggctgggcactgtggctcatgcctgtaatcctagcactttggaaggccaaggcgggtggatcacttgagctcaggagttcgagaccagcctgggcaacatagtgagacctccgtctctacaaaaaaataccaaagaaaattaaccaggcctggctgggcgcggtggctcacacctgtaatcccagcactttgggaggccaaggcaggcggatcatgaggtcaggagatcgagaccattctggctaacaaggtgaaaccctgtctctactaaaaaagcaaaaaattagccgggcgtgctggcaggcacctgtagtcccagctactcgggaggctgaggcaggagaatggcgtgtacccgggagacggagcttgcagtgagctgagatcgcgccactgcactccagcctgggtgacggagtgagactccgtctcaaaaaaaaaaaaaagaaaaaaaaattaaccaggcctggtggcacatgcttgtagtcccagctacttgggaggccgaagtgggagacagtcttgctctgtcacctaggctagagtgcagtgatgcgatctcggctcacagcaacctccacctcaaatttgccgggcacggtggctcatgcctgtagtcccagcactttgggaggccaaggcaggcagatcacttgaggtcaggagttcgagaccagcctggccaacatggtgaatccccatctctactaaaaatacaaaaattagcctggcatggtgacgtgcgcctgtaatccccgctattctggaggctgagacaggagaattgtttgaacccaggaggcggaggttgcagtgagccgagatcgcgccattgcactctagcctgggcaacaagagcgaaactctgcctcaaaaaaaaaaaaattcatattgctatataagttatttcagtaaagtatatcatgtgcctgtttggtggaaaagttaaaggaagaaaccaggaaggaaacaagcagaacagtcatcttcaaaagtaatttgtgtttaagaatgtgaggcttaagtagatgttttgcagtacattttatatagatactaatcttgccctctaggggtctatactttaagcctggcagtagtagttaacaaggataaacacaaaaggacaagtaagcaactagaaaataaacatggaggccgggcatggtggctcacgcctgtaatctcagcactttgggaggccgcggtgggaggatcacgaggtcaggagttcgagaccagcctggccaatatggtgaaaccctgtctctgttaaaaatataaaaactagctaggcgtggtggtgcacacctgtagtcccagctactcaggaggctcaggcagcagaatcccttgaacctaggaggcggagggtgcagtgagctgagattgttccagtgcactccagcctgggcaatagaggcagacaccacccccccccaaaaaaaaagagaaagaaaagaaacatggaaaaacatacaaatagaaagattaaatatttacgtccattgtgtacaagatcatagttttaaaagaaatgcatctgtggattcagggggaagggcagcagtgggagaagtcatagcagacaaccatatctattcagaagagggtgacagaacacattctgctggcaagtatcataaactagaaattttcaggccaggcatggtggtttacatctgtaatcccagcactttgggaggccagggtaggcagatcacttgaggtcaggagttcgagaccagcctgaccaacatggtgaaacctcgcctctactaaaaatacaaaattagccaggcgtggtggcaggcacccgtaatcccagctattctggaggctgaagcaggagaattgcttgaatcagggaggcggaggttgcagtgagccaggatcgtgccactgcactccagcctgggcgacagagtgagatgctgtctcaaaaaaagaaagaaaagaaagaaagaaagaaggaagaaatggaatagacagccctattcatcaccctgcaggctgaagcctaaattccttggcttgactcactaggtcctggagagcccctgctaccctctggcgaacgtgctcatctcttccccagctttccttctcacctgaccaccagttttcagaactccttccagtgggctacaaaccaccaggctgtcccatcgcccttcccctttccacgaggccagttcctactttttcttcggctcttgctttagacctctgccctccgtgagaatggctgtgtccccctaaatgcttctgccaaccttgtgctttccccactcacagctctcattgcctgtaatgaaagtgcccagattaatgtctatattgtccctaaacccagcggagatggcagtagttatctgccttatttcccctattcaacagcagctcagtgaacagttgtagggtaactgaaatgaatatgaaaatataggttaggtgttagaaaaagagctaagaggatcctttataggagtgtttattttattttattttattttttgagacagggtctcactctgtcacccaggctggagtgcaatggcacaatctcagctcactgcaacttccaccttcagggctcaagcaatcctcccacctcagccttccaagtagctgactacaggcacacatcaccacggccggctattgttttgtatttttagtagagacaggggtcttgtcatattgcccaagctagtcttgaatgcctgaactccacctggctgaggcctcccaaagtgctgggattataggcttaagccaccgccactggccagtcgtgtttattttatttatttatttatttatttatattatttatttatttttttttttagactgagtctcgctctgttgcccaggctggagtatagtggtgcaatctcggctcactgcaatgtccacctcccaggttcaagagattctcgtgccttagcctcccgagtagctgggataacaggcacccaccatcacacctgcctaatgtgtttatttttttaaaaaaagaaactgtatctttagagaaaatgtatacatgcatactttgctacatttttgttgattgttacattttacatttgtataacaatacaggcaagtcatctttgcactcataaccacatcttttatggaacatcaagcctactctgaggtacaggctttcagaagcctgaatttggaggaccatgcctgaaccaaatggagtctccagaatcaaaactgctcaaaataatcattcatggttctcagaccaaataagatctacttagaaacatttctcgacagcacgctgccatgccgacgcagaccccactctgcacgccagcccccctgcacccaccatggccacagttcagcagctagaaggaagatggcgcctggtggacaacaaaggctttgatgaatacatgaaggagctaggagtgggaatagctttgtgaaaaatgggcgcaatggccaagccagattgtatcatcacttgtgatagcaaaaacctcaccataaaaactgagagcactttgaaaacaacacagttttctggtaccctgggagagaagtttgaagaaaacacagctgatggcagaagaactcagactgtttgcaactttacagatggtgcattggttcagcatcaggagtgggatgggaaggaaagcacaataacaagaaaactgaaagatgggaaattagtggtggagcgtgtcatgaaccatgtcgcctgtactcggatctatgaaaaagcacaataaagattccatcatcactttggacaggagttaaccaagagaatgaccaagctcagttcaatgaacaaatctccatactgtttctttcttttttttttcattactgtgttcaattatctttatcacaaacattttacatgcagctatttcaaagtgtgttggattcattaggatcatccctttggttaataaataaatgagtttctgctaaaaaaaaaaaaaaaaaaaagaaaaagaaacatttctcaggccgggcacgatggctcacagaccaggcacagtggcacacacctgtaatcccagcacttttgggaggccgaggcgggtggatcccctgaggtcgggagtttgagaccagcccgactaacatggagaaaccctgtctctactaaaaatacaaaattagccgggcatggtggcacatggctactccgtcccagctactcaggaggctgaagcaagagaattgcttgaggcagaggctgcggtgagccgagggtgagccaagatcgccccattgtactccagcctgggtgacaagagcgaaactccgaaactccatgtccaaacaaaaaaagaaacatttctctgagccaagataatgttgagaaggaaatgattacagaatagcatatatgtatcataatcttatgtaacatggtgtaaatctataattatgtatgcatacaatatgtgcaaagtagtaatgttcatcaagttgtaaacaacggttatctctgaactaggattccaaatgacctttccccttttttttttgagacaagtctcactctgttgccccggctagaatgcagtggtgcaatcatggctcactgaagcctcaacctcctgagcttaagcagtcctcccgcctcagcctcccaaagtgcagggattacacgcatgagccaccacacccagactaaatatgtgttaaactaaagcagaagcatcattacccgagtaggctctataggaagaaagaggagacgagtgaggaaaggagagagaatgaaaaaaagagacttaaattgtaagcattgaaggttaggatgggaaggcgattcgcatttaaacctcagggccccatttaggcttctacctccctgaccgctgggaggctggttgcttttcacccctctgggttcacttctatttgtctgtgagctgtcagcatccttccccgcttgtcttgccctgcctctgccagggaggcagagttgggagtcgtggcacaggcatgcacgctgtgcagcctcccacacctgcaccctgaaagaccaacagacaccctaagaaacctgatacacaagcacaaactgataagatacccaaaaaggcaaaggcagacagatagcaaaacatggctaatattacacagtactgcaagagaaagtaacaccaaaacaaaacaaaacacagacatcgtctctcagttccttctcaaaaaaaaaaaaaaggccaggtatagtggctcacacctgtaatcccagcatttttggaggccgaggtgggcagatcacttgaggccaggagttcgagaccggcctggccaactatggccaacatggtgaaaccccccatctctactaaaaatacaaaaaattagccgggcatggtggctggcacctgtaatcccagctactgggaggctgaggcaggagaattgcttcaacctgggaggcggaggttgcagtgagctaagattgtaccactgcactccagcctgggcaacagagtgcaactctgtctcaaaaaaaaaaaaaaaaaaaaaaaagcgtgggtgtggtggtggctcacacctgtagtcctagcacttcgggaggccaaggtggaaggctctcttgaggctaggaatttgagacctgcctggacaacatacagaaaccctgtctctataaaaaataaaaaaactagctaggtgtggtggtgtgcgcctatagtcccaggtacttgggaggctgaacaggaagactgcttgagaccagggagttgggcctgcagtgaaccatggtcatgcccctgcactccagacagggtgaagtgggtagtttttcacttgatctcctccttattgtatctaacgtttaaacaagtctcagacctggtgcagaggtgcatgtacctccattgctggacaaggcctgacttttgcctgctggtagggcctcctcagttctaaccagacttctgcgacctcattctctatcctggttccattttccactttgtgacttcatcagttaaagatcccatttcagccaccaaggttgagaggccccaagacccagttcctttacagaatcaaccctggggtggctttaggactgggctctttggagctcatccttggacccacagtggagcgctggtctgtgctaacatcttcagataccaatcaatgggcatttggctccttgcttccactgacctcttgagtactttcaacgatcggtgtcaagggtgcccctgctgctgtttctagagcatctctgcaacccacggtggcctctcctctttctgcgggccatggacagcacagtcccttcagccctggagctgccccagcggctggcactgaacccaagggagagcccaaggagtccggaagaggaggagccccacctgctgagcagcttggctgcagtccagaccctggccaatgtcatccggccttgctatggcccccatggccggcagaagttcctggtgaccatgaaaggagaaacagtgtgcacggggtgtgccactgccatcctcagggccctggagctggagcacccagcggcatggctcctccgggaagcagcccaaacccaagcagagaatagtggggatggcacagccttcgtggttctgctgacggaagccttgctggaacaggcagagcagctgctgaagttcggcctgcctcgcccgcagctccgggaggcctacgccacagccactgcagaggtcctggccacactgccctccctggccatccaatctctggggcctttggaagatccgtcctgggccctccattctgtgatgaatacccacaccctgccccccatgaaccacttgaccaagctggtggcccacgcctgctgggctatcaaggagctagacggcagcttcaagcctgagcgtgttggggtgtgcacgctgcacggggggacactggaggattcctgcctcctccaggggttagcaatatctgggaagctctgtgggcaaatggccgcagtgttaagtggtgccagggtggctctctttgcttgcccctttggtcctgcccatccaaatgcaccagcaacggcctgtctttctagtcctgctgatctagctcaatttagtaaaggaagtgaccaattactagaaaagcaagtaggccagctggcagccgcgggaattaatgtggcagtggtgttgggggaggtcgacgaggagaccctcacactggcggacaagtatggcatcgtggtgattcaggctaggtctcggatggagatcatttacctgagtgaggtgttggacacaccgctgctgcctcgtctgctccctccccagaggccaggcaagtgccagagggtttacaggcaggagctgggagatggtttggctgtggtatttgaatgggaatgtacaggcacacctgccctcaccgtggttctcaggggagccaccacccaggggctgcggagtgcagagcaggccgtctaccacagcattgatgcctatttccagccatgtcaagatcccagactgatcccaggagctggggccacagaaatggctttggcaaaaatgctctctgataaaggaagcagattggaagggcccaatgggcctgcattcctagcatttgcccgggccctgaagtatcttcctaaaaccttggcagagaatgcaggcttagctgtctcagacgtggttgcagaaatgagtggagtgcaccaaggtgggaacctcctaatgggtgtgggagctgaagggataataaatgtggcccaggaaggggtgtgggacaccctaatagtcaaagcccaaggatttcgagcagtggctgaggtggtgctacagctcgtgactgtagatgaaatcgtagtggccaagaaaagtcccacacatcagcagatctggaatcctgactctaagaagacaaagaaacgcccacctcctgtggaaaaaaaaaaaatccttggaatgaataactagtgataccctcaataaaacagggattgccaagaagggaacaatcaccccaaaaatgaatgtttgcctttattccatgtttggtacttgattcagtttctttaaataaaaacatgaaggaacataaaatttcttttcatgtgcttagttcctttccagttctcgaattttttttttttttttagagatggagtcttgctctgttgcccaggctggtgtgcagtggcatgatcttggctcactgcaacctccgcctccctggttcaagcgattctcctgcctcagcctcccgaatagctgggactacaggtgcgcgccaccacacccagctatttttttgtatttttagtagagacggggtttcaccatattggccaggctggtctcgaactcctgacctcatgatcctcctgcctcagcctcccaaagtgctgggattacaggcgagagccaccgtgcccggccagttcttgaccttttcgttttctgtttctctctatcagattctcttcctttcctacgataagagcaggattcaattctattaagatttttaaactgagtacctatgtgggctttgggcatgcaaaacacagtgcagcaatctcttcccaactatttgagcattccctgcatgatattctgacatatatggacttatgtctagatgtcactttaggagtctgaaaacatcagttgcagcttacaagagtggtcagtccttcctgttgtggttatttgaaaaaaaagaagggactatcatcttaaagcacagagagagagagaaagcaggaaaaggggctgctgtgctggcaggcagaaatttaacttaaaaaaaaaaatccttgcctgacacagtggctcatgcctgtaattcctgcactttgggaggctgagacaggaagatcgcttgagtccaggagttcaagaccagcctggacaacatagtgagaccctgtctctacaaaaataaaaattaaaaaaaattagccaggcgtgggccgggcgtggtggctcaagcctgtaatcccagcactttaggagcccgaggtgggcggatcacctgaggtcaggagttcaagaccagcctgaccaacatgcagaaaccccatctctactaaaaatacaaaaaagtagccggacgtggtggcacatgcctgtaatcccagctacttgagaggctgaggcaggagaattgcttgaacccgcgaggcagaggttgttgtgagctgagatgatgccattgtaccccagcctgggcaacaagagcaaaactctgcctcaaaaaaaaaaaaaaaaaaaattagccaggcgtggtgatgcatacctgtagtcccagctactcaggaggctgaggtgggaggatcacttaagcccaggagatcgaggttgcagtgagctgtgattgtgccactgcactccagcctaagagacagagcaagaccctgtctcaacaaaacaaaacaaaccaaaaccagcaaacatccttggcatagataacagaagataagaacacataccttaggactatgctaaggttgttgtgtaggtgaggagaaagctgagggtagggggaagggctaggattggacaaccttgggcattaaagaaggggtctaagcagaggtgagtgggttcagcacctaatacccaaagctttttccacatttttaaccatccaagttaccctaggaaaagatcagaacctatgggacagaatctaggagatgagaaggtacaatctcttagaatcataaaaataaaaaagctttaggcatatgcagagagaatgagactcaagaaaccattgtcttatagcacgcatattagccgcaacacagcaaaacaaaattttatttatttatttattttgagacagagtcttgctctgtcacccaggcatagtgactggtgtggcccaggaaccagtgcagcggtgcagtctcagctcactgcaacctccacctcctgggcgcaaatgattctcctgcctcagcctcctgagtagctgggactacaggtgtccaccaccacacctggctaatttttgtatttttagtagagacggggttttgccatgttggccaggctggtctcaaactttggacctcaggtgatccacctgcctcggcctccccaaatgctgggattacgggtgtgtcccaccccaatttgctatatcttgattttgtctagaatctaagtatcctctttaatgtcatctttaagtgtccttttttttttttttttttttttgagatggagtctcacttgcccaggctggagtgcagtagcatgatctcggctcactgcaacctccacctcccaggttcaagtgattctcctgcctcaccctcccagtagctgggattacaggcgtccgccactaagccagactaatttttttgaatttttgttttttttttttttgagatggcatctcactctgtcacccaggctggagtgcagtggtgtgatctcagctcactgcaacctccacctcccaggttgaagagattcttccgtctcagcctcctgagtagctgggactacaggtgcgcgccaccatgcctggataatttttgtatttttagtagacacagggtctcaccataatggccaggctggtctcgaactcctgacctcgtgatccacccgcctcagcctcccaaagtgccgggattacaggcatgagccactgtgcccagccaatttttttgaattttttgtagagacggggtttcaccatgttggccaggctggtctcgaacccctgacctcaaatgattcgcccgcctcaaccacccaaagtgctgggattacaggcatgaaccaccaaccccagcataagtgtcctctttagttgtcaaaacatgtgactcaaacatcaagttggtttttttctcctactgactatggagaagttgaccagaatttgacctcaatttggccagatccagactcttcttctgagattacaggatcaaggtctcctagcatgctaggtctcaatcctcaaaggctttggctttggggttggctacatatttctcttccaagatgagctgcttgcttcaattccagaagcagttgaatttcagaaatgacaattcctggaggacattttctttttctttttttttgagagggagtttcgctcttgttgcccaggctggagtacaatggcataatctcggctcaccacaacctccgcctcccaggttcaagcgattcctctgcctcaggagtagctgggattataggcatgtgccaccacacctggctaattttgtatttttactagagacggggtttctccatgttggtcaggctgatcttgaactcctgacctcaggtgatccgcccgccttggcctcccaaagtgctgggattacagtcatgagccactgcgcctggccattcctggagtacattttctataagaacttgtagctggtggactcatcccagaccccttccagctttgtgacactgctttactgtgctccagcttgatctagcaaccagagaacaatagccacaatccagagaaaacgggaggaaaatgagaactgagtcctcggaaatgaaggagatgagaggctgacttggatagtggaggctgggactgagccttgggaactgctcatccatttgggctatatgtaggccagtcatggtggctcatcacctctaatcccagtagtttgaaaggccaaggcaggcggatcgcttgaggttaggagtttgagaccagcctggacagcgcactgataccccttttctacaaaaaaataaataaattacccaggtgtggtggcatgcacctgtagtcccacttattcggaaggctgaggcaagagaatctcttgaacctaggaggcagaggttgcagtgagccgagatggtgccactgcactccagcctgggcaacagagcaagactccatctcaaaataataataataataaattaaaaaataaaaattaactgggcatggtggtgcacacctgtagtcccagctactggggggggctgagatggaaggatttcttgagcccaggaagtcgaggctgcagtgagcagtgattggtccactgcactccagcctgggtgacagagtgagaccctttctcaagaaaaaaaaaaaaaaaaaaagacttcaatctacaaaaacattggagttctgatgaagagaaaaaggtatcaattccaaactgtgaaaagaactgtgaagagaagattgaaaacaaaacaacagaaaagagttgtcatagtttgccagtcctttctctacatgggccagcctcttctcatgcgtattgagttgtttctccagagtctttttttttttttttttttttttgagatggagtcttgctctgtcacccaggctggagtgtagtggtgtgatcccggctcactgcaccagtagacaggtatgacagatattccaaaagtagatgagtcaccttttcccctgaaacatcaagaatccccacccccccaacccccccccccccgccccccgccgcaggctaaagatcctctttcctaactagggaggaagaggaagaaggttagggtaagaatgagggagatggtggtagaatctctgagagggattctactcacctcccagtgggttccaaggagtgagattggggaaaggacaattagaatccgcagcaaagtttgggggtctgagaagagaggagattctctgcttccaatctggaaccctggggccccaaggagttccctgtgccaaccagacagcagagctgtagaccaggaatggctgaggcctcgggcggagatgggccccgggtagttgatgggatgttcgcggtgctgagcagcctcagagaacagccagggtcccccatgaagcagcaaccatgaagccgctgaaccttagggcatttcaaggtcatgagaaaaggtaggattgtaaactttagctgaggcttgagaaagacagaaaatgacctcagaccacaggacaccaagatgctgcatcagcccgtggactggagactaattgtggggtgaatgagagaaggaggtgaaggagaagatcaagaatggacttggttgaggtttagcctgatcaggaaaaatcataaaaggccaaagtttacctggaattgactagattaattattttaccatcaggcagaaaaaggggctagaaatagaaatactgagatgatttagttataaaagcatagcacgaatacttcccacacattgaagcgtaggacttaagaatttaaactctcggccgggcatagtggctcatgcctgtaatcccagcactttgggaggccgaggcaggcagatcacctgaggtcaggagtttcagatcagcctggacaacatggtgagaccctttctctaataaaaatacaaaaattgtccaggcgttttggtgggtgcttgtaatcccagctactcgggaggctaaagcaggagaatcgcttgagcctgggaggcagaggttgcagtgagccaagaccctgccactgcactccagactgggcaacagagtgagactccatatcaaaaaagaatttaaactctctacaaacgtgaattttctttttttttttttttttgagacagagtcgctctttcccccaggctggagtacagtggcacaatcttggctcactgcaacctccgcctcctgggttcaagtgattctcctgtctcagcctcccaagtagctgagattacaggcacctgacaccacgcccggctaatttttgtatttttagtagagatggggtttcaccatgttggccaggctggtcttgaactcctgacctcaagtgatccacctgcctctgcttcccaaagtgctgggattacaggtgtgagccaccacacccggccaaatgtgaatactgaataaggacttcagacactgtcctctgggtattaccaacagggtttgacactagtaattgcagcgccacataagaaagaccagacgctggttagcaaaacaatggtaatcctctgcaatgcagcacatgtttgagaagcaattttatacagtagacagggtggaaaaaatggctctttggaagttttcttctaactcacagaatgcatcagcaaggaaagatagatcccggcaagctcaggggacatatgcctctctatagtgaaaaatattttctttctttttttttttttttttttttagatggagtctccctctgtcgcccaggctagagtgcagaggcgcaatcttggctcatgcaagctccgtcccgggttcacgccattctcctgcctcagcctcctgagcaactgggattacaggcctccgccaccacgcccagctaactttttgtatttttagtagagatgaggtttcactgtgttagccatgatggtcttgatctcctgaccttgtgatccgcccgcctaagcctcccaaagtgctgggattacagacgtgagccactgcgcccggctgaaaaatattttcatatccagatcaacattcatttcttaaaacatcttaacacatgtcctctgcctcctgtgtccacagactccagaaccctagcattccagaatcccccctccctactgtggctgctcccctcttggcaggcaccccaagttctggactagtatttcccctacagaagagaacaatatcagccaatctcagacttccctatgcagatgcaacatattatgtttcctatttcattcctagtcagtcattttgattgcaaacctccttctatttcaattttattactgtgggtttctttttgttgttattgtttgttttttttgagacagagtcttcctctgtcacctaggctggagtaaagtggcacaatctcagctcactgcagcctccacctcccgagttcaagtgattctcctgcctcagcctctcaaatagctgggattacaggtgcgtgccaccacacccagcttatatatatatatatatatatattttttttttttttttttttttgagacagagtcttgctctgtcacccaggctggagtgcagtggcgcgatctcggctcactgcaacctctgccttccaagttcaactgattctcctgcctcagcctcctgagtagctgggattacaggcatgcaccatcacgcccggctaatttttgtatttttagtagagacggggtttcaccatgttggccaggctggtctcaaactcctgaccttgtgatccgcccacctcggactcccaaagtgctgggattacaggcgtgagccaccgcgcctggcctatatagatatattttttgcattttttgtagagatggggtttcatcatgttggccaggctggtctcaaactcttgacctcagatgatccacctgcctcagcctgctgggattacaggcgtgagccatgcaccaggctagtgtagttttatttacaagaggcataacaatccatgaaccaagattgaaatattgtttcagttgaaaatagtttctaaaactacttgtgatattttctatgttacattttgagaagaatctatacttgccttaattcctaaaactaaatagaaaacatttcaaaatatactcatatgttactgaaatttaaagtcttttttttttttgagacagagtttcgctcttgttgcccaggctggagtgcagtggcatgatctcggctcaccacaacctctgcctcccaggttcaagcgattctcctgccttagcctcccgagtagttgggattacaagcatgtgccactacgctcaactaaatttttgttttgttttgttttgttttagtagagatggggtttctacatgttggtcaggctggtctcaaactcccaacctcaggtgatccacccacctcggtctcccaaagtgctgggattacaggcatcagccaccatgcctggactgaaatttaaagtcttaatttagatgttcaacatcttacaacaaagatacaatctataaaatctgatgttcttttttttttttgagacagagtctcactctgttgcccaggctggagtgcagtggcaccatctcggctcactgcaacctctgcctcctgggttcaagtgattctcctgcctcagcctcccaagtagctgtgactacaagcaggtgccaccacgcccagccaatttttgtatttttagtagagatggtgttttgccgtgttgggcaggctgttctcaaactcctgacctcaagtaatctgcctgctttggcctcctgaattgctgggattactggtgtgcgccaccacgcccagcactggattttcttaaatttctcttctttcatttttttttctctactgagcacttcagcttttaataaaattttcttcttttatctatgaatactcgtaaactttttttgggggggacttatccaaatgagcttctcagagtgttgcaagctaaacatctcctctcattctgcatagaaacagtggagttctggaagtaagtgtaactatttacctttcaagtcaataaacccaagggtgcacttcggtttattgttcgaacaatttgaacatttattaagtgccaacccttgtaaagaattacccagcaaccagaattcaacttggtcagcaggcaaggagtctcgatcagacaaactcgccattttgaaatatgaaaaattatgccgggcacggtggctcacgcctgtaatcccagcactctgggaagccgaggcgggcagatcacaaggtcaggagatcaagatcatcctggctaacacggtgaaaccccatctctactaaaaatacaaaaaattagccgggcgtggcggcgggcacctgtagtcccagctactagggaggctgaggcaggagaacggtgtgaacctgggaggcggaggttgtagtgagccgagattgcgccactgcactccagcctgggcaacagagcgagactccgtctcaaaaaaaaaaaaaagaaaaattacatggaagatggctggagaagacaagggtcgcatgcttctgtgtgccactgccacagaaacatcccgggtggtcagcccctcagtgaatgaatggagctgttttgaaaccagtgggatgatgacaactgtggaaagaccccactcggatctcctgctgcaggtgtaattgactgagaacctcaactgctgtcctctgaatctaccaccaccacatttacaataagaccgtgcttcctgagggctacgcccagacagcgactatgggataataaggtcacttcctgccagattctaatggggacttgggtcagtttggccaaaatcatctgagagctgcactgcagtctgggaccctcctacttactctgttctcttttctttctggggggtcaaatttccccattccggccaggcgaggtggctcacacctgtaatcccagcactttgggaggctaaggagggcggatcacctgaggtcaggaggttgagatcagcctggccaacatggtgaaaccccatctctactaaaaatacaaaagttagccaggcatggcagcacacacctgtaatcccagctactcagaaggctgagacaggagaatcgcttgaagccaggaggcagaggttgcagtgagctgagatctcaccactgcactccaacctgggtgacagagcaagactctgtctcaaataaataaataaatataaaaataaataaaattcctcattcctccaactttctccacttttttcccctcatcagtgtttcttccataaatctcttgtatgacaatcgtcttggcatctatttttcaaaggacctgaaccaacacaaggtggtaaaatactaacataaagttactgatttagccgggtgtggtggtgcatgcccgtggtcccagctactcaggaggctgaggtgggaggatcgcttgagcccaggaggtggaggttgcagtgatccaagatagcaccactgtgctccagcctgggcgacagattgagacctcgtctcaggaaaaaaaaaaagttaaaattaaaaatataaaaaaagatgactgatatagtttggatatttgtccctgcccaaatctcatgttgaaatgtaacccctagggttggaggtggggcctggtggaaggtgtttgggtctaggggtggatccctcatggcttggatagccagtgagttctcacaagatcaggttgttgtaaactgtgtgacacctcccccatccctgctatagcttctccttccaccatgagtaaaagctccctgaggcctccccagaagccaggcagatactggtgtcacgcttcctgtacagcctgcagaactctaagtcaattaaacctcttttctttttttttttaagacagagtctcactctgtcacccaggctggagtgcagtggtgcaacctcagctcattgcagcctccgcctcccgggttaaagcgattctcctgggattacaggcgcccgccaccatgactgtattttttttttttttgaaacagagtctcctcctgttgcccaggctggattgcattggcatgatctcagctcactgcaacctctgcctcccaggttcaagcgattctcctgcctcagcctcccgagtagctggaaccacaggcgtgcagcaccccgcccagctaatttttgtatttttagtagagacggggtttcaccatgttggccaggctggtctcaaactcctgaccttagatgatcttcccacctcagcttcccaaagtgctggagattacaggcgttagccactgtgcccggcctaaacttcttttctttataaaatacccagtctcaggtatttctttatagcaaggcaaagaaaggcctaatgcgatttctctctaagaggttgccttttcctagtacttgatttgccctaccaggtcagcaactctcctcaaatgtcagtcaaggagagacaacttcaatttatagccaactaccacaccaatctctttcatcctaagaacaattccctatgccactccttaatggtacacgaagggccatgtctcaactacaccttccccatcttaacaagaacacgaacacacacacacacaccacacactctcaagtgccattattcattttgaaccaagtaagcttatcctttgaaggcactctccatttctccccttaatgaggcataattactacattaataataacacaaataaaatgcttcccataagaatagcatttccaggcgggggcggtggctcacacctgtaatcccaatactttgggaggccgaggcgggtggatcatctgaggtcaggagttcaggaccagcctggccaacatggtgaaaccccatctctactataaatataaaaattagccaggcgtggtggacacctgtaatcccagctgcttgggaggctggggcaggggaatcgcttgaacctgggaggtggagattgcagtgagccgagatcgcaccactgtactccagcctgggcagcaagagcgagactctgtctcaaaaaaaaaaaaaaaaaaaaaaagaatagcatttccaagccttatacataaacagtacctcatttgatcctcatcataacatcaagggtagacatgaccagtattattagcctcacttcacaaaggaagaaactgagactcagactgttgtctctgggtatcagtttccaagtctgtccaatgaaggattgagccctgtgacctctaagaactcttccacttctaaaattgtataatttccataatttgtctgacatcactaagacagtagttagtggcagattagggacctgagagaatgacttggtgccaggctgattctcccacaacgtgttatctttgctgccaatagcaatggctaacatcagctatgcgatatgtcctgcactgtgccagttactcacgaggcattgttatttatttatttatttatttatgtatttatttatttatttattgagatggagtttcactcttgttgcccaggctggagtgcagtggcgcaatctcggctcactgcaacctccgcctcccaggttcaagtgattctcctgtctcagcctcccaaatagctgggattacaggcgtccatcatgcctggctaattttgtatttttagtagagacagggtttcaccacgttggtcaggctggtctccaactcctgacctcaggtgatctgcacgcctcagcctcccaaagtgctgggattagaggcgtgagccaccgcgccagtccagagcattgttgaatacctactcagcattgtcctccatcccgctgcgtaaatgtattgagatttcagttacatacacacttaatggagaaggcgacaccacccctgctccaaggatgtactctgatcgacactttccattcttctggccatagtcattgggtgacttgggggctctgaactggaatgccggaacagaagtacactctctcctgctgaacatacattaggaagcactggcttctgctgctactggcagcctctctgtggccctaaggggaagcctcaggattcttgtttggaactgatagtttttagcagctaaaatctgagacgtctataccgtatccttaaaactctgaataaacaacataggcaaagacagatgatgtcactgagacccagagaggatattagaccttgcccagcatacattacctattgggggccagttaggactaaattacaagtctccagcaactgacctagggttctcttggcctcagcatgtggaaggggccccacgtgcaaaggttccggataaagatcagactgtgatctagctgatgaacagaacccagaagtatgtttgagggggaggaaggaggaggctaagagaggccttcttatgttctgcttttttgccctgaggggatgacacttaaccactgcagaggctgcagctgagccgcagggatggtcacactgaaccagtagttcttcccttcccccactctaaacctctgccaagcagagagcctctgagactgctctggagaaaggggctgcctgccaactatctgcccacctggggccagggtgagggcaaggccagtggctacattctgtgaacagctggaaaaaaagtaggcaacacagtggccttgggacaatggccttcccactctccttgtcacgaaatagcaggattaaaaaaaaagggggggaggatatttatttaatccttttgttacaaattaaagttgctaatttgttttcaaaaattgcaggaaataaagtacacgaatcaaagaaacacaaaatatttaaaaacaaaatagctattctcccaactttcttacttataggtatgtctatacaattgtggcagaatccaaagggaaggacagtttggttagtccatttggtcacagcaaatgtacctgttcatttgttcatcaacgatttgttgagcactcaccttgtgccctgaagatacagttcagaaaaaacaccgaaaaggcccctgtgtccagcagctcacatcttaatggtggaagggagatgaaggagaacagaccataataagtaagtaaacaatgatttcagactgtgccaagagctctgaggaaaacacggtgatatgatagggagcggggaaaggtactttaggtacaatgtcagaaatgcctcccccaggccaggcgagggggtgcaagcctggaatcctagcactttgggaggccgaggtgggtggatcacttgagcccaggagtttgagaccagcctggggtttcaccatgtgaaacccagactccacaaaaaaaaaaaaaaagacaaaaaaaattggctgggtgccatggctcatgcctgtaatcccagcactttgggaggccaaagcaggtagagctcaggagttcaagaccagactggccaacatggtgaaaccccgtctctactaaaaatacaaaaattaactgggcaccatggtgggtgtttgtaatcccagctacttgggaggctgaaacaggagaatcacttgaacccaggaggtggaggttgcagtgagccgagatcatgccactgcaccccagcctgggtgaaagagcaagactctgtctcaaaataaataaattaattaaattaaattaaaattaaaaaaattagccaggtgtggtggtgcatacctgtagtccccactacttgggaggctgaggtgggaggatcacttgagcccaggaggtcaaagctgtagtgagccgagattgcaccactgcactccagccttggagccttggcaacagagagagaccctgtctcaaaaaaaaaaaaaaaaaaaaaaaaaaaaaagaaagaaagagaaagaaagagaaagaaagaaaaaagaaaaagaggccaggtgcagtggctcatgcctgtaatcccaacactttgggaggctgaggtgggcagatcacttgaggtcaggagttcgagaccagcctgaccaacatggcgaaaccctgtctctactaaaaatacaaaaattagctgggtgtggtggcaggcacctgtaatcccagctactagggaggctgaggcaggagaatcacttgaacctgggaggcagaggttgcagtgagccaagcatgggcgacagagtgagactccatctcaaaaaaaggaaaaggaaaggaaaggaggaagaaacgaagaaacgaaggaagaaaggaagaaagaaagaaaaataaagaaaagagagagaagagggaaggggaggggaggggagcagggaagagaggagaggctgggcccagtggttcacacctgtaagctgaggtgaaggagtttgagaccagcctggccaacatcgtgaaaccccatctctactaaaaatacaaaaattagccagggttggtggcacgtgcctgtaatcacagctactcaggaggctgaggcaggagaatcgcttaaacctggaaggcggaggttgcagtgagctgaaatcgcaccattgcactccagcctgggcgacagggcaagactccgtttcaaaaaaaaaaaaaggagaaagaaacaaagaaagaaagaaaaatgcctccccaaggtgacagacgagctaagccaggcgaaaagtctaaagaaattcaagtgcaaaggccctctggcaaaaaggtcttggcagaaaggtggtcagtgtgcctgctgcactgaaactgctcctgtaaggcagggatcctataaggtaggccttgaatgtcatgatggggagctcggttaggacccccatgataggtaggaaggcagctggaaagagcagttctgccatttttacggatacattcatgagccatgatgggtcgtcctggtggacctctggagcctgacctgggtccacgtttgaggtctccgactttagtgaccctgggaaagttacttgagtttcctcatttgaatagccaagggtttctcgtgtttgatgccaaatgccttgtgcggggattggctccaaacctcagcctcatcagtcaatttatccttacgttcaagagcagccatttacaaaacgagctcagaaaattaaaaaaaaaatacaaactttaaatcgccagaatactgcataaactaaaagtaggccgggcgcagtggctcacgcctgtaatcccagcactttgggaggtcgaagcgggcggatcacctgaggtcaggaattcgagaccagcctgaccaacatggagaaaccccgtctctactaaaaatgcaaaaattagctgggcatggtggtgggcgcctgtactcccagctatttgggaggctgaggcaggagaattgcttgaacccaggagacggaggttgcagtgagctgagatcgcgccactgcactctagcctgggcgacagagcgagactccatctcaaagcaaacaaacaaataaaaacaaagtaaaagtaaattccccaggcaaagctgattatattgctgggataatcgactttgtcactgcagtctcacttggtactttaagaaactccatcttgatcctaggtctgggtcgatctgggcgttcctgctaattttctgttttaaaaacctaaagcaataaaaatgttgatattgacatttatcatttttatcctcgccctctgccttgttttgctgggagatctgttccacttggctgagtttagggagggcggggaagcgggggagaaaccgaggcgcagggtggagaaagggagaagccttgcagactgaacacatgagaaaacctggagaagggattcgctgctgcttatttcagggaagaaaaccgagaagtgaagcacagaggggtcaggttccgggagcggcgggaaggttgtagggggccccagggcaggtcctggagctcaggcagccggcaccgggagcccagctcaggctgcggggtgcaaccgggcaagagcgctcgggctgccgaaacgggaggagatcagaaaaaggagagacatggaaaaaaggagaggaagaggagcaacactcaagagggaaggaagaaggcagacactgaggaacgcccgcaggaacccgcagacaagcagagagccgggctgcgctgggagcggggcccgcggaaggggcggggcgccaggcggctcgaggccaatgggagggcgggccggggcgagggcggggcactaggcgaaacgacgccaatgggagggcgggccggggcgagggcggggaattaggcggtgcgaggccaatgggagggcgggccgggtcctctgggctgaggcggggtgccaggcggcacgaagccagtgggagggtgagttaggggcaggggcggggtcccaagccaatggaagggtgataccgagagggcggggcgccaggcggcgagagagccaatgggaggccgagccgaggaccgcgggcggtgggcctccccccgagaggagggagacccggaaggcggtgggggcggggagtggagctgacaacctgtcaaatccactttgggacgaactaggtcacgcgctccgcgggtcgggcacccccgcccgccaggcacggccgcggctccttcctcttcctgcccgcggtagtgggggtggggcaggcctcgggacacctgcctccgccgccggccgccggccgccgtcctcgcgcggcttcccgggcggctctgccccgaccgtagactcccggcccgctcgccgcggcaggagccgtggttccgcggacctgggcgcgctctctccctggccactgggagaccccccgcggcctcgcggggaaaacctcgggactgccccgcgcccccggccgtctctgcgtcgctccttctcgcccgcgaccgtggactcgtcctcgcgagcctgggttggcggaagctgcgggggccggggtcgcactacttggcgcggaagggccggcggtgggcggagggatccccgtccgcggggtgagccgctgggcggagccgggaggagccgcgaggatccgcagtggggagccgggaggaacctggcgccggcacccacccgccgcgcccacgcgtgccgcggtcgcttgtttcccgcgggagcccggccgcgctcggggggaggcgcgcgcgcagctggggctgcctgggtctaggagctccggagccaccgttttgtgcccgtggagccgcggggaaggcgcacgcgctcgggtcttcccggcgggtcgtcctgcactttctccctctccggtacggaccgcggcgttctgtttccaggcaaaggaaaataagtcaaagactcagaaggcagcctgaatccagggcctgggatgcagggtttgctggaacgccagccggtgcgatcgcgcccctgggattccgcttagcccgcgcgtccatttccctgcatggtggactcagtaaagccggatctgtccaacgcctgcagcgtggatgtggaggcggactaatcaactagtgctctgttattatttctacccatcccttttctccatgctaatttgcttagaactttaacattgaatggacagcaaatgtcatgttctgtttaattatcactccttgaccattatgttaatttctttccctaacaaggtgacgcattgttttaagtaacaatgaccaactcatctactcttcttccaaattgtgtaaattgaagggtaaaatgtgggaaaacgctaaatttgaatgctaaatttgaacatttcacacaacaataatttgaaatgcttctttgcaatattatggcgtttcggaacagataaaaatacttcattttcagacatttggtcaacaaatacttcttggacgtttatatgcaaagcaatgcatgtaacattttcattactttgcaagtgtgcttatcagtaaaagaattttgttttaaattctagccttcgtttaaatgtattttagttaccacattgggaagaaaataaaatattactatgtacggaatgtacagacgtatgtttttttatttacaaaaaatagaaagaaaatatggccgggtgctgtgggtcacgcatgtaatcccagcactttgggaggccgaggcaggcggatcacctgaggtcaggagttggaaactatcctgaccaatatggtgaaacccactctctactaaaagtacaaaaatgagcctgggcgtggtggcgggtgcctgcagtcccagctgcttgggaggctgagacgggaaaatttcttgaacccgggaggcggaggttgcagtgattgtgccactgcactccagcctgggcaacagagcgagactccgtctcaaaaaaaaaaaatctatatctatatatatatatagatatataaagatatagatatatagatatctatatctaggtctatataagtatatatctatagatatctatatataggtctatatagatatatgtatagatatatatagatacctatatatctagataaatgtatagatatatagatctatagagatatctatagatctatatagatgtatgtatagatatatagatctatggagatctctatagatctatatagatatatgtatagatatatagatatctatatatagatatataggtctatatatagatatctatatatagatatatatgttccttaaattcaacattaagaatgagcttattcataattagctgtagtattacacttgaactaccatatttattacatttataaatactatttataaatagtaatataaatagtaaatgctattaacatttagtaaatgctattaaggtaggaatagaggttccaatcttttaaatagaaattaaatacaaacaaagcaacaaaaagagacctttcatatatggttattggcttgtcattgtagccagttccttactgccagctaattttccaaagggaatcgttgctttctgttttgaccaattggcaacctcaacagtgctagaaactcttagccctcattgggtatataaatatatatcttatttcaaatgttttgttatctattcctactgaaggttgttttcttctctcttttttttttgagacggagtctcactctgtcaccagggctggagtgcagtggcgcgatctcggttcactgcaacctctgccaccggggttcaagcgattctcctgcctcagccttctgagtagctgggattacaggcgcccgccactatgcccagctaattttttgtatttttagtagagatggggtttcaccatgttggccaggcggactcaaactactgacctcgttattcacccggcgcggcctcccaaagtgctgggattatagtcatgagcccggccctctttttttttttcgttttttttttttttttgtgctcatcattttgatcttaatacccactaaaaagataataaaaccacaagtgtttttcttcagatcacgagattgtcaataatagaaagtcaacactgtcaaatcatgagaatgaattgcatatcattgtacaaaaattgaatactggaatttagctcctagatctattatattaccataataagaaaaactaaagaattaaaaaatctaaacaaaatgcaatcctaaatgatattgcggccaggcacagtggttcacacctgtaattcagcattttcggaggccagagcagatggtggcttgagcccaggagttggagactagcctagggaacatggcaaaacctcatctctacagaaaggaaaaaaggcaaaacctcatctatacaaaaaattagctgggcgtagtggcacatagctgtagacctagctactcaagaggcagaggcaggaggattgcgtgagaacgggatgtcgagactgcagtgagccataatggcgccactgcaccccagcctgggcaacagagcaagaccctgtctcgagacaagttcgtcttgctgcatttcagtatttttaactcctttaatgtagtgtagacaattttgatatgatgtgtcacatctttttttaacgtctaatttctttttttttttttttgaaacggagtttcactcttgttgcccaggctggagtgcagtggcgtgatctctgctcactgcaacctctgcctcccgggttcaagcagttctcctgtttcagcctcccaggtagctggggctacaggtgcctgccaccatgcccagctaatttttgtgtttttggtagagacggggtttcaccttgttggtcaggctggtctcgaactcctgacctcaggtgatccacccacctcggcctcccaaagtgttgggattataggtgtgaggaacctggccttaacgtctaatttcagaagaaagctaattctccttttttttgggggggggggacagagtctcgctctgtcacccaggctggagtgcagtggcgcgatctcggctcactgcaagctccgcctcccgggttcactccattctcctgcctcagcctctccgagtagctgggactacaggcgcccaccaccacgcccggctaatctttttgtatttttagtagagacggggtttcaccgtggtctcgatctcctgacctcatgatccgcccgcctcggcatcccaaagtgctgggattacaagcatgagccaccgcgcccagccgaagaaatctacttctttccgttcctcttaaagatgaaaattagaaacattctgccttaattatttttatttttttgagacagtcttgctctgtcgccaggctggagtgcagtggcatgatctcagctcacggcaacctccgcctcctggattcaagcagttctcctgcctcagcctcccaagtagctgagactacaggctcgcgccaccacacccatctaatttttgtatttttagtagagacagggtttcaccatgttggccaggatggtcttgatctcttgacctcgtgatccacccgcctcggcctcccaaagtgctgggattacaggcgtgagccaccgcgcccagcctttgccttaattatttcttctgttatatcccctgctagcaaacttttggaataggtttgggaaattaattacctttataaatggagttactattttgcccaaacatttcatgtataattctgtaaggatgatttttataatttcctacccaaatgtcttggcacagttttatttctcaattggtagtgaatttcctagactaggaggaaaaagcagtaagtcttcttactgcttctggggagaagggtgggtggctttaccttggtaaggacattctcagggcagctcagaatgctgaggttgaggactctgtggttggaaattcagctcaaacccaaaggggtggaatattttgtgaatgggaaacaaatacaccttgagttggaagttacaaatcagtggtcacagatatgtattgtttgtctctacaatgtctagaaattttaacattagtttccaagatttaaaaaataagagatttcagggccgggcatggtggctcacacctgtaatcccagcactttgggaggccaaggcgggtggatcacttcaggtcaggagttcgagaccagcctggccaacgtggtgaaaccccatctctactaaaaatacaaaaaattagctgggtgtggttgcaggcgcctgtaatcccagctacttgagaggctgaggcaggagaattacttgaacccgggtggtggaggttgcggtggagctgtatcttaccactgcattccagcctgggcgacagagcaagactccatctcaaaataaataaataaataaataaaataaaataaaaaataagagatttcagataagaatacagaattgtaacttcttttggaaatcagtcagatttggccatttcttgcacgattacctgcggtattgctgactagctgctgccctctttacacagggtgtacactccatatatcaggctcagtacagtcatttatcttcaccacctggccactgcagggatctgtgtttggaatactgatatggtttggctctgtccccaccctcctaaatctcaacttgaattgtaactcccagaattcccatgtgttgtgggaaggacccagagggaggtaattgaatcatgggggccagtctttcccgtgctactcttgtggtagtgaatacatctcatgagatctgatgggtttatcaggggtttctgcttttgcttcgtcctcattttttcttgctgccgccatgtgccttttgcctcccgccgtgattctgaggcttccccagccatgtggaactgtaagtccaattaaacctctttctgttcctagtttctggtatgtctttatcagcagtgtgaaaacaaactaataaatcccagcactctgggaggccgaggtgggtggatcacctgaggtctggaattcgagaccagcctgaccaacatggagaaaccccgtccctactaaaaaaaatacaaaattagctgggtgtggtggcacaagcctgtaatcccagctactcaggaggctgaggcaggagaatggcttgaacctgggaggtggagtttgcattgagccgagatcgtgccattgcactccaccctggggcaacaagagcgaaactccatctcaaaaaaaaaaaaaaaaaagaaaaaaaagaaaagaaagaaagaaaacaaactgataaagtaaatcggtaccagtagagtggggcgttgctgaaaagatacccaaaaatgtggaagggactttggaattgggtaacaggcagaggttggaaccgtttggagggctcagaagaaaacaggaaaatgtgggaaagtttggaacctcctagagacttgatgaatggctttaaaaaaatgctgatagtgatatgaacaataaggtccaggctgaagtggtcccatagggagataaggagcttgttggaaactggagcaaaggtgattcttgttatgttttagcaaggagactaacagcattttgctctgtgctagagatgtgtggaattttgaacttgagagagatgatttagggtatccggcagaagaattttctaagcagcaaaacattcaaaaggtgacttgagtgctgttaaaagcattcagtttttaaagggaaacagaggccaggcacagtggctcatggttgtaatcctaacactttgggaggtcgaggtggacatatcacctgaggtcaggagtttgggaccagcctggccaacatagtgaaatcgtgtctctactaaaaaatgcaaaaattcgctgggtgtggcagcgtgcaactgtaatcccagctactcagcaggctgaggcaagagaattgcttgaactggggaggcagagattgcagtgagctgagattgcaacattgcactccagcctgggcaacaagagtgaaactccgtctcaaaaaacaaaaaacaaaaaacaggaaaacagaacataaaagctcagaaaatttgcagcctctgatgcagtagaaaagaaaaacccattttttgaggagaaattcaagctggctgtagaaatttgcataagtcgcaaggagcctaatgataatccccaacactatggggaaaatgtctccagtccatgtcagagaccttcacagcagcccctcccatcacaggcccagaggcccaggaggaaaaagtggtataatgggccaggcccagggtccccatgctgtgtgcagcctagggacttgttgccccatgtcccagccgctccagccgtggctgaaagggaccactgtagagctcgggctgtggcttcagagggtggaagccccaagccttggcagcttccatgtgatgttgagcctgcacatgcacagaagtcaaaaattgaggtttgggaacctctgcctagatatcagaagatgtatggaaatgcctagatgcccaggcaaaagtttgctgcaggggcggagccctcacagagaacctctgttagggcagtgcagaagggaaacatggggtcgaagcccccagacagagtctctactagggcactgcctagtggagctgtgagaggagggccaccatcctctagaccgcagaatggtagatccacggacagcttgcaccatgtgcctaggaaagccacagacactcaacacaaacttatgaaagcagccaggagggaggctatagcctgcaaagccacagtgacagagctgcccaagaccatgggcacccacttcttgcatcagcatgacctggatgtgagacctggaatcaaaggagatcattttgaagctctaaaattcgactgtccttggggccgggtgtggtggctcatgcctgtaatcccagcactttgggaggccgagtcaggtggatcacaaggtcaggagttttagaccagcctggccaacatggtgaaaccccatctctactaaaaatagctacaaaaattagccaggcatggtggcatggccctgtaattccaggtacttgggaggctgaggcaggggaattgcttgaacatgggaggcagaggttgcagtgagccgagattgcgccactgcactccagcctgggcaacagagcaagactctaaaataaataaaataaaataaaataaaacaaaataaaataaaataaaatttgactgccctactggatttcagacttgcatgggccctgtaacccctttgtttggccaatttctcccatttggaatagctgtctttacccagtacctgtacccccattgtatctaggaagtaactagcttgcttctgattttacaggctcataggcagaacggacttaccttgtctcagatgagactttggactgtggatttttgggactttggggaactgttgtgaaggcatgattggtttcgaaatgtgaggacaagagatttggaggtgtcaggggcagaatgatgtggtttggctgtgtccccacccaaatctcaacttgaattatatctcccagaattcccacatgttgtgggaggaatccagagggaggaaatagaatcatggaggccagtctttcctgtgttattcttgtggtagtgaataagtctcacgagatctaatgggcttatcaggagtttccacatttgcctcctcctcatttttctcttgttgccactatgtaagaagtgcctttctcctcccgccttgattctgaggcctccccagccatatggaactgtaagtccaattaaacctcttttttggctgggtgcggtggctcacatctgtaatcccagcactttgggaggccaaggcaggtggatcacgaggtcaggagatcgagaccatcctggctaacatggtgaaacaccatctctactaaaaatacaaaacaattagctgggcgtggtggcgggcacctgtagtcccagctactcggtaggctaaggcaggagaattgcctgaacccaggaggcggagctctcagtgagccgagatcatgccactgcactccagcctgggcaacagagcgagactctgtctcaaaaaaacaaaaacaaaactttttgttcccagttttgagtatgtctttaccagcagtgtgtaaatgaactataatacaaatactctaggtcatataaattgttttttctttttgagacagggtcttgttctgtcacccaaactggagtgcggtggcatgatctcaactcactatagcttccacctcctgggctcaagcagtcctcccaactcagcctcctgaatggctgggaccacaggcccacatcacaatgcctgggtaatttttgtacttttagtagagatggggtttcaacatgttgctcaggctggtctcaaactcctgggctccaagcaatctatccaccttggcctcccaaagtgctaggattccaggtgtgagccactgtgatcttaggattttgttcaaggtaaatacagtgaactagtaaatagaaagttattaagatcatatatggcaactggatgcatcccattattttgtttaccagtccccaggcacagggaatggtcaggcaatatttaggtgaaaatgttaataaaaaatggaaataatggctgagcacggtggctcacacctgtaatctcagcactttgggaggctgaagcgggcggatcatttgaggtcaggagttcgagaccagcttgaccaacatggtgaaaccttgtctccactaaaaatacaaaaaagttatctggctgtggtgatgcgcacctgtaatcccagcttcttgagaggctgaggcaggagaatcccttgaccctgagaggcagaggttgcagtgagccaagatcacgccagtgcactccagcctaggagacagagccagacactgtctcaaaaaaaaaaaaaaaaaaaaaaaaaaagaaagaaaagaaaaaaaaagaaaataatgtttttgtgctttcctttccatgtagaaagtccttcccctgggccgtgcatgatggtgtgcacctgtagtcctaggtactctggaggctgagatggaaggatcgtttgagtctaggagttcaaggctgtagtgcattatgatcacacctatgaagtagccactgcactccagcctgggtaatgtagcaagacctcatctctaaataattataatagtgaataataataatgacgacagtccttgccttgattcaaatgaacatcactggaaatcttgactaattagaacctagcaatagtagtcaactgtgaaagattatactagaagaagaaattccccaaagtactacagaactaataacgatgatgacaataacaatgtcttgacattgagcagagtgctggacattgttctaaataatttatatacactatgtcgtcatattttagtttcctcattgtgcacatgtaccctaaaacttaaagtataataataaaaaaaagaaacacacacaaataaataaatgaactctacacagcaaaaaaaaaaaaattaaatattttagtttcctatttgctacctcatcttcctttacttttttttccttttctttcttcttctttttttttttttttttttgagacggagtctgactctgttgcccaggatggagtgcagtggcgcaatctcagctcactgcaacctctgcctcctggggtcaagtgattcttctgcctcatcctccctaggagctgggaatataggcacgtgccactgggcccagctaatgtttgtattttagtagagatggggtttcaccatgttggcctggctggtcttgaactcctgggctcaggtgatccacctgccttggcctcccaaagtgctgggattacaggcttgagccactgtgcctggcctggttttgttgggttttgatgaggaagtagatggaggaggggaggtggtagctgtgtctaggtctgtctccatctattggcccttagtgctctcgtatttctctctcttttgagtttctcattttgctcctaccacatttgctgcctcagtcttggctcattctctctctcctctgcccttgtcagggaatatttcttactgacatgagaagtcagatgccagtagaaaaagacacaccaaccatgacagaaaagacctgaaagaggatatgcttggggtacaattagagaaaggcaggaaagaacaaacattcagtcactttttaggaccagtaagggccaaaggttagcataatcccgaaggtacagcaaactacagcattcatcttgtgcctgggttggagggttcaaggcagctgaagaaatggaagatgaggccgggtgctatggctcacgcctgtaatgccaacactttgggagcccgaggcaactggttcacctgaggtcacgggttcgagacaagcgtggccaacatggcgaaaccccgtctctactaaaaatacaaaaatcagccgggtgtcgtggtggacacctgtaatcccagctactcaggaggctgaggcaggaggagtgcttgtacccaggaggcggaggttgcagtgagggagatcacgccactgcactctagactgtgccacagggcgagactccatctctaaaacaaataaacaaacaacaaaaaaaccaaaaaaccaacgaagcccaatgagaacagcagcatgctggaaaagattccaggtttgttcagatgggttgtgtattatgatgattgtgagtagtctgaagaaatagaacaattctgtgaagttacatttagttgggatctacatgcattgatagagaaatgtttaaataaaatgtatatcttcggccgggcgcggtggctcacgcctgtaatcccagcactttgggaggccaaggagggtggatcacgaggtcagaagttcgagaccagcctagccaacatggtgaaaccctgtctccactaaaaatacaaaaagttagctgggcatgttggcaggcgtatgtaatcccagctactcgggaggttgaggcaggagaatcgcttgaacctgggaggtgaaggctgcagtgagctgagaccgtgccactacaatccagcctgggcaacagagcgggcctccgtcttaaaaaaaaaaaaaaaaaaagtgtatcttcatataacggaatgcttatgagaagggtttaataaaatggcctaataccatatgttagatgaacagagaaccatgaaataaaattatgtataaaaacacatttaggagttaaaaggtggtgttagtttttttgtttttttttctgagactgagtttcactcttgttgcccaggctggagtgcaatggcgtgatgttggctcattgcaacctccacctcccgggttcaagtgagtctcctatctcagcctcctgagtaactgggattacaggcgtgtgccaccatgcccagctaatttttgtatttttggtagagatggggtttcaccatgttggccaggctggtcccaaactcctgacctcaggtgatctgcctgcctcggcctcccaaagtgctgggattacaggcgtgagccaccgtgcccagctggtgttagttttttaattgattaaaatacatttaaaaggatagaataaaagggcagatgaaaatatggcaaaatcatagcagttatggatttccaaaaatttttctagtgacatgttgtacatacacaatcagggaagaaactaaaaatcaaactgagcatgtgcttattgagttttagttccataaaagaaacaaaaaaattatactacagctacagatgttactgtctccagatttcaaaaatgttttccaactatctcaagggaactgggcaagagagaacagatggctgagcataacctactcccaatgctagagaagtaaatcaaagtgcatttcatactgatgctacctcagtaataccggctttgagcagagagggatggtgtgaattattttcccccactgtaacccttaaagcccgcccgtcccccagctttgtttgaggaaggatagtctatgacggatggatagcatctaagaagggatgttagtttgctagggctgcggtaacaaagtagcacagactgggtggtagcagaaatgtactttctcttagctccagaggcctgaagtccaatatcaaggcattagcagggttggcctctcctgagggcgtctcagcttgtagatggtgtctttttttgtgtcttcacatggttttccttatgtgtgtgtctgtgtcctaatctcctcttgttataaggacaccagtcatattgaatcagggcccacactgataacttttttttttcagacagggtctggctctatcacccaggctggagtgcagtggctccatcatggctcactgcagcctcaacctcttgagctcaagcaatcctcctgcttcattcagcctctcaaatagctgggactacagaagtgtgccacaatgcctggctaattaaaaaaaaattttttttttggccaggggcggtggctcatgcctgtaatccagcactttgggagactgaggcaggcggatcacctgaggttaggagttctagaccagcctgatcaacatggagaaaccccgtctctactaaaaataaatacacaaaattagccgggtgtggtggcacatgcctgtaatcccagctactcgggagggtgaggcaggagaatctcttgaacctgggaggtggaggttgtggtgagccgacattgcaccattgcactccagcctgggcaacaagagcgaaactccatctcaaaaaaaaaaaatttttttttttttggccaggcatggtgactcacacctataatcccagcactttgggagtccgaagcaggcggatcacccaagatcaggagttcgagaccagcttggccaacatggcaaaacgccttctctactaaaaatacaaaaattagccaggcatgatggtgggcgcttgtcaacccagctactcaggagaatcccttgaccctggaaggcagagctgagatcgtgccactgcactgcagcctgggcgacagagcaagactccatctcaaaaaaataaaaaaaaaaaaaaagaaaaagacaagtataacaaccaaacaaattccaaactgcattgactttttctacagcaaggaaattttgatttgaaccaaagaatccttcatttcattttgtagcaggctccagtcccttttgggaaaggtaagggtatatataatgaataaataaataatatcactgtattttgcattggcagaaaaaaaatctgtatgtgcaagcaacaatcttttccttgtttcaatattaaattgcttacttggactaaagtaaacctttagaagtataaaactgcttggtattcgtatcagttagcataaattcaaaggaaatcaatcagcataaccaaatgacattgagtcaatgttgacttactcttctactggacttctttttttttttgagacagggtcttgctctgtcacccaggctggagtgtaggaatgatccccacttactgcaacctccaccccccagctcaagtgatctcccacctcaacctcccaagtaactgggaccaccccgccatcatacccagctaattttttttttttttgagacagagtcttgctttgtcccccaggctggagtgcagtggcccaatcttggatcactgcaacctctgcctcccgggttcaagcgattcttctgtctcagcctcccgagtagctgggattacaggcacaggctgccacgcctggctaatttttcttttttttcaggggaggtggggggacagggtttcactgttgttgcccaggcaggaatgcaatggcgtgatctcggctcaccacaatctccgccttccaggttcaagcaattctcctgcctcagcctcctgagtagcgtggattataggcatgcaccaccacgcccagctaattttgtatttttagtagagacaggggtttctccatgttggcaggctggtcttgaactcccaaccttaggtgatccgtctgccttggcttcccaaagtgctgggattacaggtgtgagccactgcgcccggccacctggctaattttttgtattttagtagaaacggggtttcaccatgttgccaggctggtcttgaactcctgagctcaggcaatccactcacctaggcctcccaaagtgctaggattacaggcgcaagccaccacacccggccctttttttgtatttttagtagagatgtagtctcatcatgttgcccaggctggtttgaactcaagtgatccaccctgtcctcccaaagtactaggattacaggtgtgagtcaccactcccggccaagacttctttttatttacatttcatgggaattatattttggagatgcctaaggcacagaaaacttaaatgatgctatagactgaattgttttcccccacccattcatgcgtttaacccctaacccccaatatcactgtatctggagacaggatctttaggaggtaattaaggttaagagaggtgcactgatcccagcccctctctctgccacatgaggacacttagagaaggtggcagccacaaagcaggaagaccgctcttgccagaagcagcagctgcaggcacactgatcttgggcttcctagtctccagaactgtgaaaataaatttatgtttatttatttacagacaaggtctcactctgttgcccaggctggattgcagtgtcatgatcatggctcactgcagcctcaaattcctagactcaggtgattctcccaccttggcctcccaaagtgctgggattacaggcatgagctaccatgcccagccaattctgttgtttaagccacccagtctgtgtgttttgttatagcagccggcagactcatacaaatgacctgcctaaacccttgactgtctcctttgtagctttcaggtcttcatcttacatatgtcttcattatttccttttctgaagaaatgacacccagtccaccctagcaaaagtaagccccatgctcattctctgtcagagcacttttttgtttctttttttttgagatggagttttgttcttgttgcccaggctggagtgcagtggtgtgatctcagctccctacaacctccgcctcccaggttcaagtgattctcctgcctcaacctcccgagtagctgggattacaggcgcccaccaccatgcccggctaatttttatagttttagtagagacagtgtttcaccgtgttggccacgctggtcttgaactcctgacctcaggtgatccacccgcctcagcctcccaaagtgctgggattataggtgtgagccaccaggcccagccatcagagcactttttagaaagcatttatcctggccgggtgcggtggctcacacctgtaatcacagcattttgggaggccgaggcaggtggatcacggggtcaggagtttgagaccagcctggctaagatggtgaaatcccatctctactaaaaaatacaaaaattagccaggcgtggtggtgggcacctgtaatcccagctacttgggaggctgaggcaggagaattgcttaaacccgggaggcagaggttgcagtgagctgagatcgcaccactgcactctagcctgggtgacagagagagactctgtctcaaataacataacataacataacataacataacataacataacataacataacataacataacataacattacataacataacataaaatgcatttatcctagtcggtattgatttgtttacttgttgattttcacttgcatatcacggagaccctctctctcttgctctgtcaagtgccttctcaaggcggaaggcctcacacatggcaggcagtacaaggaaatcctctgtctatcaacaactgtgccctatcgggctgagcaaataggcctgaggactttagttttccagtcacaatgaagaacatgtaataagtggggccagtggaagctgtttccaacctaggctaggcaattaacccactgactcaatgtgatgatgctgtcttgatttgattctctacttcattcaaaacaggctcagactgaatagaaaagagaatctgttcaaagtttggttacagattccacttgttaattgatgatgatggtgaacgagcagagtgtatgacattttgctaagtgttcattgtgaaaagagttcagagcttggatccaggaacttgccccaccaatggggttttgctgtaggcagctgtacggccttgggcgaggcatttacccctttctctctctgtgttctttctttctttctctcccttctttctcctttcttttctcttctcttctccttccttcctttctctctctcccttcctcccttccttccttccttccctcccttccctcccttccttcccttccttcccttcctttccttccttttcttttttgagacaaggtctggctctatcacccaggctggagtgcagtggcatgatctctgctcactgcaaccgccacctcccaggttcaagcagttctcatgcctcagctgcctgagaagctggaactacaagtatgtaccaccatgcccggctaaattttttttttttagaaatgcgtttttgccatgttgcccagcctggtctcaatctcttacaatctcaagttgccagaaggtgctcctttgcctcttaggagggtgacaaggtggtagataaacttctccatggccaaagatggcatgctccctgtagaacctgctcccttcagaaactcccccaccagggctgggcgcagtgacatacctgtaatcccagcacttcgagaggctgatgtgagaggattacttgaagtcaggagttcgagaccagcttgcgcaaggtagtaagactaccccaacttctctgtaaaacattgaaaaaattgaaataacaaaaaagaaagaaacttccctaccagaatatgaattaaggtgtttccccatgaagaaatcacatcgtaaaatagcatgattaatacaatcacattctaacaatagcatgagtatgaggtcaagcctggtcacaccctccaactctgtaaaagaaaacttagctgggggctgggcatggtggcccacgcctgtaatcccagcgctttgggaggccgaggcaggtggatcacttgaggttaggagttcgagaccagcctggccaacatggtgaaaccctgtctctactaaaaatacaaaaagtagccaggtatggtggcgcatgcctgtagtcccagctgctcgggaggctgaggcagaagaatcgcttgaactcggaaggcaggggttgcagtgggctgagatcttgccactgcactccatcctgggagacaagagagagactctccatctcaaaaaaaaaaaaaaaaaaaagtcaggcacagtggctcatgcctgtaatcccagcactttgggaggccgaggtgggtggatcacgaggtcaggagttcaagaccagcctgaccagcatggtgaaaccccgtctctacaaaaattagccgggcgtggtggtagtcacttgtaatctcagctactcgggaggctgaggcaggggaatcgcatgaacctgggaggcagaggttgcggtgagctgagaccacaccactgcactccagcccgggcgtcagagcgagactctgtctaaaaaaaaaaaaaaagaccaggcatggtggctcatgcttgtaatcctagcactttgggaggccaaggcggggggatcacgagatcaggagatcgagactatcctggctaacatggtgaaaccctgtctctactaaaaatacaaaaataattagccaggcatggtggcgggtgcctgtagtcccagctacttgggaggctgaggcaggagaatagtgtgaacccaggaggcggagcttgcagtgagccgcgttgctccactgcactccagccggggcaacagagcaagactccttctcagaaaaaaaaaaatttagccgagagaggaaagggaaaggctcttttgcattagagtttagagaactgattgtagagctaacaggcaacttgcaggccagcgttccctcaagtagaaatgaactctaatacccatgatcaagcccaggaacgtgttggtttcttttttctatgcctctaagaagttaattaattccagctgagtcctagcctttcctggccaacgtacctggctatctccacagtcaatctcacacctatgaaagcttatactttttctaagggatggtgtaatagttgggagagctaacccaggattagacaggccaaggtggtccaagttgggaatttaattatataagtgcataactcaccattttctacttttcctgacatatagatacaaaccctcaaaatgacaggaaagtaaattttaaaatgaaggaagggcaggaaggaagaaaagaagaaagggagttcaaatgttaaacattaaaatggtctactctcttgagtacacctgcagatattcctcaagttctagcattggcccatctctctctctttctcttccatgatgattttgtaacttaggtactgtttgccaaatgtccaacctaactttcaaacaatattcagagcagctgttttcaattctcatctttatgcagtgaactctgaaatccacatctctattttgttttttgttttttgagacgagtcatgctctgtcacccaggctggagagcagtgacacgatctcagctcactgcaacctccgcctcccggcttcaagcgattctcctgactcagcctcctgagtggctgggattacaggcacccgcaccacacccagctaatttttgtatttttagtagagacagggtttcaccatcttggccaggctggtcttgaactcctgaccttgtgatccacccaccttggcctcccaaattgctgggattacaggcgtaagccaccacgcccggccttatgtctctattttaatcttctcatttactctgggtctgtatttttagcacttactggacacctccacctggatgtgccacgacccttggccttgctgggcccaggaggaccttctgcttcctcccaaaccaacatcttctgtgttacctattcctgttcatgatggacttctgatgagcccggtcacccaggctctaggtaagtgggtctcaacttggctgaacactacattagcaagagggacattttttttttggagacagagttttcctcttgttgcccagactggagtgcaatggcgtgatcttggctcaccgaaacctctgcctcctgggttcaagcaattctcctgcctcagcctcccgagtagctgggattataggcatgcaccaccacgcctggctaattttgtttttttttttttagtagagatggcgtttctccatactggtcaggctggtcttgaactctgacctcagtgcctccgaaagtgctgggagccaccatgcccggcctaagaaggacatttttgaaagctccccagctgattgtaacgtgcagctagtgttaagaactactctgcctttctttcttttttttttttttgaggtggagtctcgtgctgtctcccaggctgatgtgcggtggcatgatctcagctcactgcaacctccgcctcctgggttcaggcaattctcctgtcagcctcccaagtagctgggactacagacacatgcccccacacctggctaattttttgtatttttagtagcgacagggtttcactgtgttagctaggatggtctccatcctgacttcatgatcctcctgcctcagcctcccatagcgctgggattacaggtgtgagccaccgcacccggcctactctgctttttgcaggctcacagttgcgagtccaatctgtgacttttacccctaacgtagctcagaaatctatttccttccttctttccaccctccttccctccctccctccctcactcccatcctccttcccttcctttctgacagagtctctgtcacccaggtgggagtgcagtggcacgatcttggcttattgcaacctccacctcccaggttcaagtgattctcctgcctctgcctcctgagtagctgggattacaggcatgtgccaccacacccagctaattgtatttttagtagaaatagggattcaccatgttggccaggctggtcttgaactcctggcctcaggtgatctgcccacctcgtcctcccaaagtgctgggattacaggcgtgagccaccgtgcccagctctatttccttctttctattcccagtattatccctttagtttaaacaccatgaaagcacatcttggtttcttgttttccctgctcctactcatgcctgacaaatcctttcaatgtatggttctgatcatattagccctcatttcaaaaccttcctgccatgtgccttagtcaggcagtcatatctgttaatgatgaggcccctgcctcttagccaagcttgttaagtatcctctactccccccattaaaaaaaaaaaataggccgggtgcggtggcttacgactgtaatcccagcacttcgggaggccaaggcgggcggatcatgaggtcaagaggtcgagatcatcctggctaacatggtgaaaccctgtctctactaaaaatacaaaaaattagctgggcgtggtggcgtgcgcctgtagtcgcagctactcaggaggctgaggcaggagaatcgcttgaacccaggaggcagaggttgcagtgagccgaggtcgcgccactgtactccagcctgggcaatggagtgagactccatctaaaaaataataataataaaaataaataatagaaaccgggcctcactatgttgcccaggctggtctcaaactcctgggcttaagtgatcctcccactctggcctcctgaattgctgggattacaggtgtgagccaccctgcttgacttctactccctttaatgaacgcttatgacaacgaaggaaagttgcttgcccttccctacacatgcccttttcctgcctctgtgcctttgctcacgcagtttccgccccctggggcaccattctgcacatgtctccatcctgtgttttcatcaagggctggcccaaatgctaccatctcccaggacagccttccctgatctgtccagctaggagtaaattcttcctttgaattctcttagaatttacatattctgtcaaaaaaccactgaagggagagcaatttgcaaaataatgaattgtttttctgctttaggacattggttctcaaaattgagtatacatgagaatcatttggagaactcatttcaaatgcataccccaggcagagcgtggtggctcatgcctgtaatcccagtactttgggaggccaaggcaggaagatcgcttgacgcttgagcctgggaggttgaggctgcagtgagctgtggttgtgccactgcacttcagcctgggccacagagcaagaccctgtcccccgccaaaaaaaagaagaagaagaagaagaggaacaagcctgttgcttatttcaagagattctcaggcttatttccagagattctcagttttttctcacatggtgttcctgtccaccatactttaagaaacattgagctaagaggttctttgttaatttcacgtcaggtggattcatgaatacgtcgacttgttggagtttcgtgatataaatccagccatactagcaaactgttaacagtcctgaaaacagtgtaaagtttttcatataccaggactgaaaactcaagtggatgggtaggttgagggttcactgctgaggaccacaggaagtggtaggactacaagggactacggagcatctctggtattcacctttcagtaacgatttccatctgagaatttggagcaactactgccagaatttccattttcccagaaagttggaaatccagaattttaggtgacatttccagattattacatggtaacttaaggttttaacaactctgtgaggtttgatataacccagttgcaattgatttaatccaacaattagctttcataattgaagtgtaaatagaagtaaatgttggtttgttttgctgcagaatgacataaaccattatttcatctatatagtgacaagaaatccacagaaatgaagagacaggctcattttaggatttcctggaatcattaatttttaaaaaattattttctctctccttccttccttcctctctcttcccttcctttccctttcctcttcctttcctttcccttcttccctttccttcctttctttttctctttcccttcccttccccttcccctttcccttcccctccccttcccctttcccttcccctccccttcccctttcccttcccctccccttcccctttcccttcccctccccttcccctttccctttccctccccctctccctttccttttctctttcctttcctttttctctctccctgtccaggggcccaatctcagctcacagcaacctctgcctcccgggttcaagtgattctccttcctcagcctcccgagcagctgggattacaggcccccactaccatgcccggctaatttttgtatttttagtagagacgaggatttgccatgttggccaagctggtctcaaactcctgaccttggccgggtgtggtggctcatgcctgtaatcccaccactttgggaggccgaggcgggcagatcatgaggtcaagagattgaggccatcttggccaacatggtgcaaccctttctctactaaaaatacaaaaattagctgggtatggtggcatgcgcctgtagtcccagctactcaggaggctggggcaggagaattgcttgaacccaggacgtggagcttgcagtgagccgagatggcaccaccgcactccagcctgggcgacagagcaagactctgtctcaaaaaaaaaacaaaaacaaaaaacaactcttgacctcaggtgatccgcctgcctcggcctcccaaagtgctggtattactgagccacctcccctggcctacagatttaaaatatatatcttttcatatttttagtactcagagatggatgattagatatagtgtctctctccattaaagtcaacaactgtgggccaggtacggtggctcatgcctgtaatccctgcacttcaggaggcggaggcaggaggatcacttgaggccaacagttcaacaccagcctgggcaatataggaagaccccatctctacaaaaaaattttaaaatgagccagtcatggtggcgtgcacctctagcccagctggttgggaagccaagctgggaagatggcttaagccctggagtttgaggctgcagtgagctgtgatggtaccactgccctccagcctgggcaacagagtgaggccttatctaaaaaaaaaaaaaaaaaaaaaaaaaaaaaaaaaaaaaatcaacaactgtggctggtggctcacacctgtaatcccagcactttgggagcccaaggcaggaggatcacttggagccaggagtttgaggccagcctaggcaacatagtgagaccttgtctctacaaaaataaaaaaagaaaaataaatcaacaggctgggtgtggtggctcacgcctgtaatcccagcactttgggagcccgaggcgggcagatcacttgagatcgggaatttgagaccagcctggccaacatggtgaaaccccgtctctactaaaaatacaaaaattagccaggcgtgctggcacatgcctgtaatcccacctacttgggaggctgaggcaggagaattgcttgaacccgggaggcggaggttgcagtgagcagagattgcgccattgcactctagcctgggtgaagaagcgagactctgtctaaaaaaaaaaaataaatgaaaataaataaataaatcaacaactgtattttaaattataagtgtagccccttgtttcattttactatttaagagacatgagtcatacttctatgctgtgctggaaatggcggagaattgacaagtatggaatttcccagcccccaactgtaggatcctgaaaatgacagaattgtaaacagatatttcacgttaatacaaagacctcagaataggcttttttattcccacgccagtcccatctttattctaacgtgccacgctccaatgcagcggttctcagcgtgtggcctgaggacccctgggattctggaggccctttcgatgggtctgtgaggcccttcgttttccaacttcatatccatgtgaggccagatactcttcatgtaattcaaccaaaacatcagactgcaatagattgaatgtagatatgagaaccagctgtcctctattaagccagatagcaaagagattcataaaactgtaaaacaatgccactctttatggtgtcttttgttttggagaatataattatttttaataaaaatgtgttctttacattaacatgatgggtttattgttcttttaaaatgaagtaatgaagtgtttttaaattttctcaattttagtttctaatatggtaaatatcaaaaaatatgatccacataaacgaacctcctggtgggttctttgtaatttttaggagcgtgaaagtgtcctgaaaccaaccaggtgcggtggctcatgcctgtaatcccagcactttgggaggctgaggcgggcagatcacgcagtcaagaaatcgagaccaccctggccaacatggcaaaaacccatcgctacttgctctgttgcccaggctggagtgcaatggtgtgatctcggctcactgcaacctttgcctcctgcgttgaagcgatcctcttgcctcagcctcccgagtagctgggactacaggtgtgcaccaccacacccagctatttttcttatatttttagtagagaccaggtttcaccatgttagccaggctggtctcgaactcctgacctcaggcacctgctttggcctcccaaagtggtgggattacaggcgtgagccaccatgcccatttttcttattccaacattatctcttgatctcacaactctgatatctagtcagaaatccttcttttttcttttcttttctttttttttgagacagggtctcgctgagttacccaggccagagtgcagtggtgtgatcatagctggtgtggaactcctgggcccaattttaaagttgcagaggccaggcacagtggctcactcctataatcccaacactttgagaggctgaggaaggaggatgacttgaggccaggggttctagatttgcctgggcaacatagtgagaccctgtctctccaaaaaaaaaaaaaaaaaactgaagaaactgaggttcacaggttactaacacggttagtaaataaataaatcagaaataagattaatcttgtagggctgggcacggtggctcatgcctgtaatcccagtactttgggaggccaaagtgggtagatcacttgagcccaggagttcacgaccagtctggggaatgtggcaaaaccctatctctacaaaaaaatacaaaagttagctgggcgtggtggcatgcacctgtattcccagttacctgggagtctgaggtgggaggattgcctgaggcccaggaggcagaagttgcaataagccaagatcacaccactgtactccagcctgggtgacagagcgagaccctgtctcaaaaaagcagaaacaatgattaatcttgtagctcttccattacaatttatgtcttttaaaaatgctcctctctttttgtctttccttccgagtgtttttttctatcctctctctgaatgcaacaagaagggaagtggggaatggagaccaatagcaaaatagaaccatctcttctaaaccttttgccttgcctctctgcttaaagctgctatcatttcatcattaattaaaggcgatggagcaaaggtccctgggttgtcatttgttgctgttgcaccatctaacattgatttgagtgtttataatggggttggtactattcagaatatctgatgacaaatcttggcttctatctttttttgtttttgagtttcactctgtcgcccaggctggagtgcatggcgcaatcttggctcactgaaacctcagtctcttgggttcaagcaatttccccctctcagactcccaagtagctgggactacaggcaccgaccaccatgcccacctaatttttgtatttttagtagagacggggtttcaccatgctgaccaggctggtctcaaattcctaacctcaggcgatccacctgcctcagcctcccaaagtgctgggattagaggcatgacccactgtgccagccaatttgtctcacctgaggtcaggagttcaagactagcatggccaacatggtgaaactctgtctctactaaaactacaaaaattagcggggcatggaggcagatgcctgtagtcccagttactcagggggcgggcgggggcgggagaatcgcttaaacctaggaggtggcagttgcagtgagccgagattgccccactgcactccagcctgggggacagagtgagactctgtctcaaaaaaacaaaaaaaagaaacttggcctctatcttattgcagtgtttgcagcagcaggggtaaacccaaagtatcagctactcctacaattatttctaattagtttataagaggttctttgtaattaccagagaattggggtctatctgaagtttaggggcatcataatacttcaaaaaaataacaaacctatgctggagtgactcctatgggagacttagagctctgtggaatttcccacactcaccctccactctgctcctcctggccacactacccatgctgggaaattcatcccttctcatcccactgcaaggtaccgttctgtttctctcacactaaaattgctttcttccaaggtgtccctggggctaaaacagataattaagaattttttcgctgggcgtggtggctcacacctgtaatcccagcactttgggaggctgaggcaggtggatcacctgaggtcaggagtttaagaccagcctggccaacatggtgaaaccctgtctctactaaaaataaaaataaaaaaattagctgggcatggtggtaggcgcctgtaatctcagctacttcgggaggctgaggcaggagaattgcttgagcctgggaggctgaggctgcagtgagccgagatcgcaccattgcactctggcctgggcgacaagagcgaaattctgtctcaaaaaaaaaaaaaaaaaaaaagatttcaagacgaagaaatctcaaacttctttctctgggctaccactataatataaaaacaagaattcaacagagataataatgccttaaactttttaaaaagattactagttggagcttttcttacttttctcaagtatatattctttactataatgtctgttcagctttcagaaaattaacaggttatattgtcaaaaaggttttccaaagttctaggttataaactacagctctgtaacaggaataggggaggaaaaagcaggttagagacattccattttttactttatagcttgaaaattgctttaattttcatgcaggaagcaggtattgcttttgtaattgaggctttttaattaaaaaaaattttccccattgtttaatatctggaaaaaaataatcttaacttcaaagtgttagctattatcctatgttgttatagtagagagctttttgagacaaaaattacttctagctgatgcttttataatccagaatcagattttaaagcaggtgcagatcctaagtgaagcacaagcctgtatcttcttgaagtagggtaacattttctggattctgcagctatgaattacaggatataaaatttatcgggcagctctcagaaccaggacaggctcagaggggttcgaggacaatattttaaaatattaactgaaatctccttcacaattttttatattgtccttttcccattaggaaatttttttttctttttttgagatagggtctccctacattgcctaggctggagtgcagtggctattcacaggtgcgatcatagcacagtacagtcttgaactcctaggctcaagcaatcctcctgcctaagcctcctgagtagctgagactccaggcatgggccatcatatctggtttgatatctagaaatgtatcaatacatttgcagtagtctaaaaaagcaaactcatcaatttactgaaaactgaacagatatatagtaaagaatatatacttgagaaaagtaaacaaagctccaaatagtaatccttttaaaaagtttaaggtggctgggcatggtggctcacgcctgtaatgctaccactttgggaggctgaggcaggtggatcacttgacatcaggagttcaagaccagcctggccgacatggtgaaatcccatctctaagagaagcacaagcctctgtcttcttgaagtagggtaacaaatacaaaaattagctggggatggtggaagatgcctgtaatcccagctactcgggaggctaaggcaggagaatcgcttgaacctgggaggcagaggttgcagtgagccaagatcgtgccactgcactccagcctgggcaacagtgtgagactctatcacaaaaaaaaaaaaaaaaaaattaaggtgttattatctctgttgaattcttatttttatattatagcagtagcccaggaaaagaagtttgagatttctttctcttacttagacaccttcttagcctgatgccagaagtctacagcagatttcagaggtgatgcagaaattttagaatttcccttcccttcccttcccttcccttcccttcccttcccttcccttcccttcccttccctttccttcccttcccttttcccttcccttccctcccctcccctcccctcctctcccctcccctccctttccttcccttcccttcttttcttttatttattttcttttcttttatttattcttttcttttcttctctttctctttcttttatagggtctcagtttgtcacccaggctggagtgcagttgtgtgatcatgattcactgcagcctcaaccttctgggcttgagtggtcctcctgcctcagcctcctgagtagctgggaccacagcatgtaccaccatgtcctgctaatttttaaattttttagagacagggttttgctatgttgttcaggctggtctcaagctcccggactcaagcagtcctcctgcctcagcctcccaaagtgctggaattacaggcaggagtcactgcgcccagccgatgcatttctttaagatagggaacatgacaatgttacctccattgtccttgaggccacttacctttgtcctccctgccatatgtcctgctgccaattccccccaacatttggcatacaataggaggcttccagctctatgccaagagaggaggtacatgcaagaggtaagagcaggaagggaaatagcaaaatgatcagtatttcagatgatataatcatttctattaaaaattcaataaaattggctgggtggggtggctcacacctgtaatcccagcactttgggaggccgaggcaggcagatcacctgaggtcaggagtttcagaccagcatggccaacatggtgaaaccccatctctactaaaaattagctgggcatagtggcatgcgcctgtatctctcactatttgcaacagtaatagtaatagtgggctacttcactgagcacagccagagctgggagctggatggtatggaggtctctctaattgaggagatggaattgaaagttcagagaaaccaaggcaggcagagtttataaggcagagaactggagaggagacagctgcacaagtcaaggcctccagagagctgcagagggtgcccctaagctgcccagggcttacaggggagacaagcacctaaggccagggaaagaactacctgaaagaagcaggcacaagaatccaagctcccaaagggctgggagtagttgatattttcaaaagctggtgagaaaaaatcatcccagaaaggaattgcctcaggaatagagaaaaactagcctaggacatcgaaggtgactcaggtcctatctggtaaatctccaaaggatcaaactgttcccaagtaactcagcagtgtcctagaacagagctcaagaattttttaaaaatataagaatttggaaactcagtctgaaaaaaaaaaaaaagaattaatacagcaaacttctctagatccaggtagatcatctactccccaggtagatattcaataaagatttactgcttggctctttgaaagaaagtggcagcagggcctggtggctcacacctgtaatcccagcactttgggaggctgaggtgggtgaatcacaaggtcaggagttcgagaccagcctggccaatctggtaaaaccccgtctctactaaaaatacaaaaattagctgggcgtggtggcgggcacctgtagtcccagctactctggaggctgaggtaggagaatcacttgaacccgggaggcggaggttgcagtgagccaagattgcgccactgcactccagcttgggtaacagagtgaaactttgtctcaaaaaaaaaaaaagttagtgaacttaaagacacatcaatagaaactttaaaatgaaacaaagagaaaaagcctttaaaaaaatgaacataacatcactaagtgaaacaactttgcatacctaatatacatgaagctggagtactggaagaagaggggaaagagaagggacatttctttttaagaaataatggtgggctggcatggtagctcatgcctgtgatcccagtactttgagaggctaaggcgggtggatcacttgagcccaggagttttgaggccagcctgggtaacatgacaaaaccctgcttctacaaaaaatacaaaaaaattagccaagagtggtgacgcatgcctgtagttccagctacttgggaggctaaggtggaaggattgcttgagcctgtagtcagaggttacagtgagctgagatctcaccactgcactccagcctaggctacagagtgagactctatcttaaaagaaagaaagaaagaaaaggaataattgtcaaaaattttctgaatttgatgaaagctataaacccacagatccaagaagttccgtgaaccccaagcaaaagatagaaacaaaaaacctacattaagtcacaagtataataaaaatacataaaactagtgttaaagagaaaatctaaacagctgtaacagatacttgatataatttgtccagagggataaaaataagaatgacagctcacttcttgccaaaattttgttatatgagatgaattgtgcttagctgtgttttgtgtttttgtgttttggtttttggtgttttttgaggcagagtctcactttgttgcccaggctggaatgcagtggcataatctcggctcactgcaacctctgcctcctgggttcaagcgattctcctgcctcagcctcctgagaagctggaattacaggcacgtgccaccatgcccatctaatttttgtatttttagtagagacgaggtttcaccatgttggtcaggctggtcttgaagtcccgacctcaggtgatccgcccacctcggcctcccaaagtgctgggattacaggcatgagccactgcgcctggcctactgtgttttgtgtttaactgagttttccattcctaagagcagaagacatccttcctgatggaatagtgctttgtatatatctggtaaattatgcagaatacacatttattttaccgtcttagtttttactgcagaggaggaaaataatgatacattttctgttactcatttagtagaaatttcctacttaaagaaataatacgccagacgcggtggctcacgcctgtaatcccagcactttgggaggccaaggcaggcagatcatgaggtcaggagatcgagaccatactggctaacacggtgaaaccccgtctctactaaaaatacaaaaaattagccaggcgtggtggcgggcgcctgtagtcccagctactcgggagactgaggcaggagaatggtgtgaacccgggaggcggagcttgcagagagctgagatggcgccactgcactccagcctgggtgataaggcaagactccgtctcaaaaaaaaaaaaaaaaaaagaaataataaattaagaacatgatcctttttaaaaattatttcttgagatggagtctcactttgtcacccaggctggagtgcagtgggcctatcttggctcactgcaacctccacctcccaggttcaagcgattctcctacctcagccttctaagtaactgggattacaggcacccaccaccacgcctggcttattgtagacaatgatccatttacgggcaacacaaatatatgatagtggtgacagtcataattagtgttttgtgactgcctttgtatagaactttagtagggatttcatagatataatctaaatgacatatcctcaatatctgtgctccttttcttttttgagataaagtttcaccccgttacccaggctggagtgcagtggctcaatcatagctcaagcagtcctcctgtatagttgggactgtgcgcacatgccactgcaccctgattttatatatatatgttttgttttgttttgttttgtttttaagaaggagtttcactcttgttgcccaggctggagtgcaatggcatgatcttggctcactgcaacctctgcctcccgggctcaagtgattctcctgcctcagcctcctgagtaactcgggttactggcgccccccaccacacccggctaatttttgtatttttgttagagatgggttttcaccatgttggccaggctggtcttgagctcctgacctcaggtgatccacctgcctcagcctcccaaactgctgggattacagttgtgagccatcgtgcccggcttttttattttattttatttttagtagagatgaagtcttgttatgttgcccaggttggtcttgaactcctgggctcaagcaatcctcttgccttggcctcccaaaatgtcaggattataggtgtcaaccactgtgcccaggcatttttccttttctagtaacaagaatcctgatttttttgctgggcacctggctgtgaacactacaatgctcagcccctcttacagctggagtgggcaccttctggaaatcatccttccctttctcctctttctcctggccagcacgcagaggagcaggccagggctgagacagctggcatggaccacctgaggccatggagtgacgtgcagccaagagcctgacagaggagtcagggtccctcacccagggatggcagaaccagccttgattttatctaagggagagatggacttctatctgctcaagccactgattgttggcattttcattacttgctgctgaaccttatcttcattaatacaaataggttgtcattatatattttcttttttctttttttcttttttttttttttttgtttcagagtctcgttctgttgccaggctggagtgcggtggcgcaatctcgcctcactgcaacctctgcctcccgggttcaagcaattctcctacctcagcctcccaagtagcttggattacaggcacccaccactacgcccggctaacttttgtatctttttgtagtagagatagggtttcaccatgttggccaggctggtctcgaactcctgaccttgtgatctgcccacctcggcctcccgaagtgctgggattacaggtgtgagccactgtgccaggctgtcattatttatttcctaaaggcattagacaagttcctaagacatggcaaaatttgaatatgaaccaggtctgttttctgtaaaactttgttattttcagtaaattattcttcttaccactaatgtttacaaaaatggcagctgtatactattaaagatttgcagagaatacaaagtcaaaatatcagtagccactgagagctttaactgaagctctcagataaatatttaaagacctaggacttttaaagggactatttacagtggaatagtgtcataaactgaattttgaaaaaacaaacagaaagtgtaaaagaaagctctccaagggaccaatactttaatttcaggagtgttctcatcctttgtaacatggtattttctatatagtgtgaaaggaaaataaatcttgggaccccaaaattactaagccaaggaaaaagtcaggctgggaagtgtcaggcaaacctgcttcccattttattcctaaataagatagttacaaagataaaaaagctatatacctcatgtaatcatgattgtggtatttttatttcttatttatttatttatctttttgagatggagtcttgctgtgtcgcccaggctggagtgcagcggcgcaatctcggctcactgcaagttccgcctcccgggttcacgccattctcctgcctcagcctcccgagtagctgggactataggcgcccgccaccacgcctggctcttttttttgtatttttagtagagacggggtttcaccgtgttagccaggatggtctcgatctcctgacctcgtgattcacctgccttggcctcccaaagtgctgggattacaggcatgagccaccacacctggcctgattgtggtattttaaaaaaaaaagaaaaaagaaaaaaagtaaattagaaaaaagctacatggctgggtgtggtggctcacgcctgtaatcccagcactttgggaggccgaggcaggcagatcacaaggtcaggaatttgagaccagcctgaccaacatggtggaaccctgtctctactaaaaaaatacaaaaattagctaagcgtggtggcgcacacctgtaatcccagctacttaggaggcttgaactcgggaggcggagattgcagtgagccaagattgcaccacggcactccagcctgggcaacagagcagactctgtcttaaaaataaataaataaaaataaataaataaaagctacataccttcctcacaatttgcccccagagaaattccttgtgggcctcaagatctttaccctaaaacagttctgttgaatttcaccctggcaatgtaaattgatagcttatctttacagatgagggaccgtccctctgctcacctgagacaaaggcatatctgattgcttcctctactggttatgtaaaaatgcagattcactgagtcatgctcagttatgtattcagtgaaaggctgatcaaggactccaaagaatgcaacctttttttttttttttttttgagacagagtctggctcagttgcccaggctggagtgcagtgaggagatctcggctcactgcagcctctgcctcccaggttcaagtaattctcctgcctcagcctcctgagaagctgggactaaaggtgcaccaccatatccagctaatttttgtatttttttggtagagaaggggtttccctgtgttagccaggttagtcttgatctcctggtctcaagtgattccccctgccttggcctcccaaagtgctgggattacaggtgtgagccaatgtgcccggactagaatgcagtcttttgtctcttatctacctggacctggaagccccaattttgagttgtcctgccttttgggaccaaaccaatgtacatctttttttcattttttatttttttgagatggagtttcgctcttgttgcccacgctggattgcaatggcacgatctcagccaactgcaacctccgcctcccgggttcaagcgattctcctgcctcagcctcctgagtagctgggactacaggcgcccgccaccatgcctgtttaattttgtatttttagtatacacggggtttctccacgttggtcaggctcaaactcccgacctcaggtgatccacctgcctcggcctcccgacctcaggtgatccacccacctcggcctcccaaagtgctgagattacaggcatgagccaccgggcccggccaaaccaatatacatcttacacatattgattgatgtctcatgtcactctaaaatgtataaaagcaagctgtatcctgaccattctggcatatgtccgcaggacctcctgaggctgtctcacgagtggtcattagccttggcaaaatcaactttctgaaatgactgagacctgtctcagatattttgggttgacaatacacacacacacacacacacacacacacacacacacacagagttttggtgacagggttagagaaaaataatatctactttcatggcttacaactctggttttacaacagaagtaaaaaaaattttattctaatagcatgatttatctttgccaatttttgaaaatttttattttattttattttattttttggagagaagtgcacagtcatagctcatcagaacagaatatcttaccaggaggcatgtcacccttgtctccttaaaacctttccccgcacacacacaaaacactctcattttggattttgtgcctatgttcatgtcattccctctgtttgcaattgctttctttcccaccaatcaactaactgcgctaattactaagtcttgatcttctcctccatgaaggcttcctggattggtctagtctacaacagtagttctcaaagcacagtacggcagcagcagtgtcacctgggactggaaattcactcctgcaaccccagacctactgagctggcaaccctggggggcccagcactctgtgtcattgagtctaagatgcttttgatgtgactcagattagcttgtcactgctctaaggccatattgatccctcccttctctgggtccccatgccacgtacagttcacagtacatcacttggagctgaatccccttttaaagaattgttatagtaggcttccctagattcaggtagattgtctactccccaggtagatattcaataaagatttagtgcttggctctttgaaagaaggtggtggctcatgcctgtaatcccagcactttgggaggccaaggtgggcggatcacaaggtcaggagttcaaacccgcctgcccaatctggtgaaaccccatctctaaaaaaaatacaaaaattagctgggtgtggcagcgcataactgtaatcccagctacttgggaggctgaggcaggagaatcgcttgaacctgggaggcggaggttgcaatgagctcagattgtgccatagcactccaggctgggcaacaagagtgaaactttgtctcaaaaaaaaaaaaaaaaaattgaatgctaaaggtcaccgcagcaatcaatgtcatcttctgttgctgtggatgtttatgttattattattattattattgagacaaagtctcgctctgtggcccaggttggagtgcagtggtgtgatcttggctccctgcaacctccacctcccgggttcaagcaattctcgagcctcagcctcgcaaatagctgggactacaggcccgactgatttttgtattttagtagagacggggtttcactatgctgcccaggctggtctgtaactcctggcctcaagggatctgcccacctcggcctcccaaagtgctggcattacaggcatgagccaccacgctcggctggatgttcatattaacacaagatgctgtatcaagacccacgcgatactgaacagacatgacccttatccttacatgtgaagatgtggaatggtcctctcaggtacatgactccacagggaatgtatatattgtcataataattctacttactaactttgattgagcacctattgtgtgccaggtaatgttctcagcaggactagctgcataatttgcagggctcagggcaaaatgaaaacacagggctccttgttcgaacagcagagaaaagtgctgttaaaggtaccaagtacaggccgggcacagtggcttgcgcccataatctcagcactctgggaggctgagctgggaggatcgtgtgagctcaggaatttgagaccagcctgggcaacgtagtgagacctcatctctacttcagaaaaaaaaaaaatcagctaggcgtggtgttgtgcacctagtcccagctactcaggaggccaaggtgggaggcctgagcccgggagttcaaggctgcagtgagctattactgcaccacagcatgccagcctgggcaactgagcaagaccctgtcttaaaaaaaaaaaagggtaccaaatacaaagtattctttttttcatgatctatctgtgtaactgtcctgtttgtaaatcttctgttgaatattatactccctgcagcatcaaggatgctcctggaggagtggggacgctcccaagggctggggtccctgccctaccattctgtgttcacaggcgcatccatctgccactgagccccactctgactagccactagaccaatgcaccatgccctggctaggggccaggagcctaccacccaatctgtggcagagaggtcaccctccaaggcattgcaaagtttgcaccagcacacactaggtacctgggtaggcagcaggcaagaggcttgcccccaccgggggtgctcgggagcatgctgtgtgctcaagacaccagggaacacgtgccttaccctgatcctcctgcacccacactcaggccctgcccagagtgaagggtggccaggtggccaggtgggagtggggagggggccatggaacccagggtgcaggggacaggggaatgggcagtcaggaacctgccagggggaggcagggaggtgggaccacacactgcactacaagtccatgatgcatgcgcactccattgccctgtgggaacagaaattcaaagacaaaatcattaagaatttcaggctgggtgcagtggctcatgcttgtaatcccagcacttcgggaggctgaggcagatctcatgaggtcaagagttcgagaccagcctggccaacatggtgaaaccacatctctactaaaaatacaaaacttagctgggtgtggtggcacgcacctgtaatcccagctactcaggaggctgaggcaggagaatcacttgaacctgggaggcggaggttacagtgagccgagatcgtgccattgcactccagtctgggtgacaagaacaaaactccatatcaaaaaaataaaaaataaagaatttcaagatgatgactgcagaacattcagtcccaagtgtgggacccttttgagcatggggacgctgtgtcacggcactaacagcatacccctgaagccagcctcgttctgagacttttgtgagacttattaaatctccacgcaagcctataagggtattgtccccaattagcagacaaggaagttgaggcatagacaagtggcctgcccaagattgcttagctgggcggatgggtggggtgataccagcccagtctcacccacatctgcctgcttcaccttgctcattgctgctcttcagagaatatttgcagagcaatagaaattcagaaggacagccaaatagttacagctcatgctcgtccagttggcattaaagctctgtcctcactgcagtccccaccccccaccaatggtttgttgatcctctcccatagcagaagcaggaacactgaaaccatgataggtatgagctcaggagacgttcccaggagatctgcctatggccttggggaaaactggtagagctggttggagctggccctctccccagctgccttccacaattagctcagggggcacacttagtccctcctggaggtttcacgacctggcaccagatgcagaccctggtcagctctgttaaggaaggactctgtgagcaggtgctggtgtcagccaggacttggggtaatcttctagaactttactgtagttttttcagtgtccacacttcctggaattcgtctagtttatttcactgaaagtgggcaggatctttgaaaagacactctcaaaagaattggattccccttatctattcagcatttcctttgtcaccaaagtgatcagtcagaagtagttagaaagtagccccaacacggccgggcacagtggctcacgcctgtaatcccaggactttggggggccgaggcgggtggagcacgaggtctggagttcttagaccagcctggccaacatgatgaaactctgtctctcctgacaatacaaaaattagctgagtgtgatggcaggcgcctgtaatcccacatactcaggaggctgaggcaggaggatcgcttgaacccgggaggtggagattgcagtgagctgagattgcaccactgcactccagcctgggcgacagaatgagattctgtctcaaaaaaaaaaaaaaaaaaaaagtagcctcaaaaatttagacaaactagtggtgtgctggtaattgttttgtaaacagctctctggaatacattttttttttcttttttttttttgaagcggagtctcattgttgcccagacctgagtccagtggcctgatcttggctcactgcaacctctgcctcctgggttcaagtgattttcctgtctcagcctcctgaatagctgggattacaggtgcctgccaccacacctggctagtttttgtatttttagtagagatggggtttcaccatgttagccaggctggtctcgaactcctgacctcaggtgagctgtcctgcttggccccccaaagtactggaattacaggtgccaccgtgcctggcctggaatacatttttttcaaaggtgctgtttgtagcttttaatgatttctatggtgctgatattccactaaaacaaatttcaggctaccagggtgatatctccctggttgcaaaatccctgaaattttgccagtctgctcctgcaggctggtaagacccaatgtgtttccgtccagcacacctcttgacatggaccttccatcaaggacaccaaagtgctttaggtgagtgtcctaattgttccagtgatttgggggcaagctggaacaaggaaaaagagctataatacagtcatatcaattttacagctgagcatactgaggttccaacacataatattttgccgcgggtgccccagcaaaggcccaagccttagataaggaggctgttgaacagcttccagctgagaccatgtcacatggctgaggtatggagatggctaaggtgtgccaccctagaggctatagtctttaggaaggaaagaccttgagaacaagaggaagtagtgaccagatgcctaagtggcgtgattgattgattgattgattttgagatggagtttcattcactcttgtcgcccaggctggagtgcagtggcatgatgttgctcgctttaactttggcctaccaggctcaagcgattctcctgcatcagcctccctagtagttgggattacaggctcccgctaccgcgtccagctaatttttttgtattttttgtagagacggagtttcatcatgttggcctggctggtctcgaactcctgagctcaggtgatccacccgcctcggcctcccaaagtgtggggattattattattattactgagacggagtctcgctctgttgcccaggctagagtgcagtggcacgatctcagctcactgcaacctccacctcccaggttcaagcgattctcctgtctcagcctcccgagtagctgggattagaggcatacgccatcacgtttggctaatttttgtctttttagtagagatgggctttcaccatgttggccaggccggtcttgaactcctgacctcaagtgatctgcccccctcggcctcccaaacttctgggattacaggcgcgagccactgctcccggccattgtttttgagacaagatctctgtcatccagactggagtgcagtcgcatgatcatggctcactgtagcctcaatctcctgggctcaagcaatcctcccgtctcagcctcctgagtagctgggaccacaagtgtgtaccaccacgaccggctaatttttttgtttttttattttttagtagatatgaggtctgtctatgttgtgcaggctggtctcaaactcctgagctcaagtatgctcctgccttggcctcccaaagtgctggaattacaggcatcagccaccgtacctggcctacccggtgtgatttgaaagatgctgcgaaattctcagaggagggatagatgctctaggcctctcctccatactcaggagagataacatggggatggtggcaaaaagaatcaagtgacttcaacaatttcatttagttgtagaaaaagcattgaccctggctgggtgtggtggctcacgcctgtaatcccagcactttgggaggccgaggcaggcggatcatgaggtcaggagatcgagaccatcctggctaacacagtgaaacccctctctactaaaaatacaaaaaattagctgagcgtggtggcatgtgcctgtagttccagctactcgggaggctggggcaggagaattgcttgaacccgggaggcagagcttgcagtgagccaagattgcaccactgcagtccagcctgggtgaccgatcaagacttcgtctcaaaaaaaaaaaaaaaaaagaaaaaaaagaaaaaaaaaaagcaatgacccataaagaaagagcctgtttgctcctatatatttaaatcacatttggccgggtgcggtggctcacacctgtaatcccagcactttgggaggctgaggtgggcagatcacttgagtccaggagttcaagaccagcctggccaacatggtgaaaccccatctttaataaaaatacaaaagttagccgggtgtggtggtgcgtgcctgttatcccagctgcttgggaggttgaggcatgagagttgcttgaacttgggaggcggaggttgcaagatcatgccattgcactccagcctgggcaacagagtgggactctgtctcaaaaaaataaaaaataaaaacaaataaataaataactcacatttgactgccagctggatttctcttgagtttttctcctatcacccctcctccaatattcttactagtatcaccatcgttaccagtattcatcgtatatattctcagagttttctttaatcaaacttggccttgctagctcttagaaagagtttccattagggcaacattactatcaaatatcttttttttttttttttttttttttttgagacggtctcactctgtcacccaggctggagtgcagtggtgctatctcagctcactgcaaccttggcctcctgggttcaagcgcttctcgtgcctcagcctcccgagtagccgggactacaggcatgcgccaccagattcagctaatttttgtattttttggtagagacaaggtttcaccatgttggccaggcggtttcaccatgttggccaggctggtcttgaactcctgacctcaagtgatccgcccacctcgtcttcccaaagtgccaggattacggttgtgagccaccacgcccagccccaaatatctctttatatagctatgggtggctacgagggacacatttgatggaatgcgatccgaggcctctggagagatttttcatgggcatgtatctgttgggaagaacctcagggtggaggccattcctctttctaaattagctagtgtagaagacagggcaaagttctcataaaatttctaacatcgacgagagtgttggcattagaaatgagaagacagaaaaagtatgaaaatgcaaaaatggaaaatgtacataaatacaaaattttattaaatagtattcattgattttaaatgtatacaacatgcttgttggtatttaaaaatagaatgatggaggatgatttggtgggagtaattgtttgaaaaaaaaatcaatttaacatcactttgctttccacttctgctgccaagaaatctcaggcagtatcttctaattcaaacataagtgtctccagaaacctttggatcacatattacaaagccccatctgttttaccctctcaaaattagcattttagcttaattcacttatacattttctgacattagcttgattcttctcttcttcctttttgtcatcttaaatcacacctggcatcttttagatttggattcaactgaaaaaataatttttagctattttaagtcctttttagtagtaagcagagtgtaaataaaatttaaagcataatgatgcaaacatatatacagctaatgtttcttgcaggattgtttacaatagcaaaaactggaaacaaatgtctatggattgagaggtggttaaaacaataattgctaaatcattaataattcttaaaaggagtgaaatatatatgtgtgtgtatatatctatatcctgatatgtatgcaaggctgtatatgatctatgtaagtggaaaaaagcaagttgaaaaaacagcaaacagatagttttatatgttgaaaaaaatcaaggctgttcaaaaaaggtatctttgtgtaagggcatagaaagtagcttgcaaggcacacactaagtgaggaatgtgatttgctctggaggggaacagggtaaaggcaaaggtggcaaggggacagtcccatttttcccgtcggcttctggtatgcttgaattttctacaatatgaatgtgtgggccggcgtggtggctgatcacaaggtcaagagttttagatcagactgaccaacatggtgaaaccctgtctctactaaaaatacaaaaattatccagacatggtggcgtgtgcttgcagtcccagcgactcgggaggctgaggcagaaggatcgcttgaacctgggagagcggttgtagtgagctgagatcgtgccactgcactccagcctaggcgacagagtgagactccgtttaaaaaaaaaagtgtgcatgtatgtgttattttgcaattagaaagtccaaaccaaggccaggcatggtggctcatgcctgtaatcccagcattttgggaggcagaggcaagaggatcacttgagcccaggagttcaagaccagactgggcaacatggcaaaaccccatctctacaaaaaaaaaaaaaaattagcagagtttggtggctcatgcctgtagtcccagctatgcgggaggctgagatgggaggattacttgagcccagcaggtaggggctccagggaactgtgttcacaccattgcactccagcctgggtgccagagggagaccctgtctcaaaaaaagaaaaaaaaaatccaaagcaaaaactattaaatgaccaagcatatataataaaataacacatgtcacaagggccatcacaaatttctgaaggtttcctttctactcctattttgaatcatttcctactcaaggcaaaataaaaagaatttttaaaaaaaattttaaaaatagagatggggctgggcggggtggctcacaccagtaatcctagcattttgggaggccgaggtggatggattgcctgaactcaggagtttgagatcagcctgggcaacatggcaaaaccccatctctactaaaaatacaaaaaaaatagctgggcattctggcgtgcacctgtaatcccagatacttgggaggatgaagcaggagaattgcttgagcctgggaggtggaggttgcagtgagccgagatcgtgccactgcactccagcctaggcaacagcacacacacaaaaatcataataaaataaataaacagaaatagagatggggtttcgtcatgttgcccaggctggtcttgaactcctgggctcaagtgatctgcccaccttggcctccgaaagtgctgggattacaggtgtgagccaccgaacccaaccaaaaagaaaaaacttaaaacacatacaagagaggaactttattagtattgaagataacgagtgtataactatctatctagtaagcataaagagatgttaattttcagtagaatacaagatagaggtaatatatatttgtgtgtgtacaattttgttttgtttatggggaggacattttcttcaccatcatcatcatcatcatagtcattgatgtcatgtcaactgccattactgtatggcaggcaatgccttaagtttacttttattaactcacctaatcttaactacagcccaattaggaaggttctatggttattcccattttacaggtgagaaactgaagcagagagaggttaaggaactcggccagggttacacagcttgtaagtgggggagctgggattcaaatccaggcaggatgaatccagagtccatgctcctaacctcaactctacacgcgagaagccaaatgaacacattcattcgtatgcaggtatctctctggggtggagagtcctgtgttcctgcagaggctcgtccagcaccatctcctctgcatgccaagtcttccctcagcaatttctcaacacaccctcaccttttttagagacagagtctcactctcttgccgaggctggagtgcagcggcaccatcatagcttactgcagccttgaactcctaggttcaagcaatccccctgcctcagcctggcattacaggcacgtgccaccacgcctggctaattttttatttttttgagacagagtcttgctctgttgcccaggctggagtgcaatggcacgatctcactgcaacctccacctcctgggttcaagcaattcttctgcctcagcctcccgagtagctgagactacaggtgtgtgccaccacgcccagctaatttttgtatttttagtagagatgggatttcaccttattggccaggctggtctcgaactcctgacctcgtgatccatctgcctcagcctccccaagtgctgggattacaggcatgagccagcacgcctggctttttttttttttttttttaactttttgtaggcacagggtcttgctatgttgcctagtctggtcctgaactcctgacctcaagtgaccctcctgactcaccctcccaaagtgctggaattataggcgtgagccactgcactcagcctacttctcccttttacacaatccacttttccttggtatcctcccacctcagccttccgaagtgttgggattataggcgtgagtcactgcaaccggcccctgttccttgttttttgtttttgttttatttttattttggtcctgcacttggttgaggagataagcttgccttgagaagcaattataaaaaagagaggaacaccagagaaatgggggtctcagagttgtgatggtggtttggggcaaggaataggaagtaaggaggtcaccatgggacactggtgatagaagcagaggggaaaggctgggcgcagtggctcacgcctgtaatcccagcactttgggaggccgaggcaggtggatcacgacgtcaggagatcgagaccatcctggctaacatggtcaaagcctggctctactaaaaatacaaaaaattagctgggcgtggtggcgggcgcctgtagccccagctactcaggaggctgaggcaggagaatggcgtgaaacccgggaggcggagcttgcagtgagctgacatcgcgccactgcactccagcctgggcgacagagtgagactctgtctcaaaaaaaaaaagaaaaagaaaaaaaaaaaaagaagtggaggggaaactagcccgggcgtggtggctcacacccgtaatcccagcactttgggaggctaaggcaggtggatcatctgaggtcaggagtttgagaccagcctggccaacatggtgaaaccccatctctactaaatacaaaaatttagccagacgtggtggcacatgcctgtaatttcagctactcaggaagctgaggagggagaatcgcttaaacccaggaagtggaggttgcagtgagctgagattgtgccattgcactccagcctgggcaacgagagcaaaactctgtgtcaaaaaaaaaaaaagtggaggggaaactagacaggaaagctatgacttagtaattaatcagcagcagcagcaggtgcaggaacaacccttaggctttctcgtatgtggttttgttgaactagctctgtagcggaggactgtacctatcactttttgtagataaaaaggaagtaggtgaagttgaatgatgagcaatcaaaaataaaataaaaaggaagtagaagtcagcttccaaactcaaggaatttttttttttttttgagatggagtcttgctctgtcacccaggctggagtgcagtggcacgatcttggcttactgcaacctctgcctcccgggttcaaactattctcgtgcctcagcctcccgcgtagttaggattacaggcgcccaccaccacagccggattttttcttttttttgtatttttagtagagagagggtttcgccatgttgcccaggctggtctcaaactcctgagcttaggcaatctgctcgcctcggcctcccaaagtgctgggattacaggcgtgagccatcacacccagctgaaactcaaggtatttataatttatggtaatatgataatgatatccacagatgaacacagaaagaaatagatgatagatagacagatagagctaattgccagtaaagaaacaaatactggccaggtacagtggctaacgcctgtaaacccagcactttgggaggccgagtcaagcagatcacctgaggtcaggagtttgacatcagcctggccaacatggtgaaaccctgtctttactagaactacaaaaattatccaggcgtggtggtgggcgcctgtaatcccagctactcaggaggctgaggcaggagaattgcttgaacctgggaggcggaggttgcagtgagccgagattccgccactgcactccagcttgggctacagagcaaggctctgtctcaaaacaaacaaacaaaataaaaaaaaaaaaaaaaaaaaaggaaaagaaatactaagcagagggtttgggttttagatcacatgtcagctccagcttcgttatgccgtctggggtagcctccttcacctttcccagagcctgttttcccagctttattacaggtagatgactcctatgtcattgggttgcagtgaggaccagacgaggtaacacacgcagaagagacctgtagagccccactggggtgcttcctgcccaatccctccttccctcccaccctccacaggtgtcagacccgtgtctcagtcagaagactttccctgccgacgtatgctccctctaattccaccttgacatttgtttcccagaagtctggaactggcgcgggggctttggaagtagcaagtagcaatacagtagcagcaatgagtgatggaagctgatagaaaatgcagtcactttggttagcggttggcctgcacgagatggcgtgggcatgtcaatctgaggtctctgcctctggtagacaagatttctatgcatgaaatagagtcctgttgcagcctgagaccgaaagtgctggcagggttaaagaaatcagggctgcaaatcaactgggatctgctatattcacaggacgttggagtttggatcttgctcatggctggcgaagtgtttagatccttttggatgtaagtggtccccttctttgtttacatcttttacagaattttccagtcttatttccggggctggcggtggtatttgctcagttagtgagctagaagctgtgaggcctcacccacattcccttttctgggccagcactccaaccccagccgccagcgatcaaggctgcctcttctctgggatgtcatccttggctggcaggagccagtttgctccaggtttttgctgtcctgcccctgcccccatgactgatgcagaggcacagaaggggcccctgtatctccggaggggtgaatctgccagggacacctgctgcgtgggacaggctaagaccagacttccggaaatcctccccggtcagctgcatctccttccaagctttgcttccctactttgccttgcaggtccttccagaagagcactccccatcaacccgcgggcagctgaattcccacctcagactctgctccaagggcgccgtgtctacggaggcgacgctgaggatggcttatcaggttgggtcactcaccccaccacgaggacctgaccttaaattctcggtgcatcctaagtgtgacccagagaccgcctgcgtcagaagcacctagaatgctgtggaagcaccttcaatgcagattcctgggcccaaccctggttccactgaatcggggtcagctggtgggcccaggaattggcattttcaacagcttccaattgtacaccagaatactcaagcttgtgactcccctgctcactgttttcttcatcctttctcacttcctgctgagtacatatgtattttactacttttagagatacttttacaataaaggcagtcttgaaagtgtgtccggaattggtgggttcttggtctcgctgacttcaagaatgaaggcgcggacctgagtgttacagttcttaaaggcggcacgttgggagttgttcgtttctcccggtgggctcgtggtctcgccggcttcagaagtgaagctgcagaccttcgcggtgggtgttacagcccatagaggcaacgagttcggaattgttccttcctcccggtgggctcctggtctcgatagcttacaggaacgaagctgcagaccttagcggtggatgctacagctcataaaggtagtgcagacccaaagaccaagagaacaaaactaccacaacgcagaacagaaccctagcgggttgccgctgctggctcaggtagcctgcttttattcccttatttggccccacccacatcctgctgattggtccattttacagagtgctgattggtccgttttgacagagtgctgattggtgcgtttacaaactttagctagacactgagtgctgattggtgcatttacaatcctttagctagacagaaaagttctccaagtccccatctgacccacaggcccagccggcttcacctctcaaaagcatttaatcaattggattgtgtgtcccaccaaacaagaacaatgtattcatctttgtatcaccacagtctgacactctgcctggcacctaatatgtgctctgtaaactatttatagaatgaataaaacattaaatgcttgcatcatgttgaacaggggatacaaagaagtttaagccactctcatgttcctttaagcagattataattcagatcaggggccgagtgtggtggctcacacctgtagtcctagcactttgggagcccgaggtgggtgggctcaagggttcgagaccagcctgggcaacatgaatacacagctcttgttaaggattttattctttattccaagaacaataggaagccagggaaatgggtcagtcaatgtgatgggcaatgaaaggctggctggaatttgggatgagactgtaggagcactgccagggtgctgcacggctcggctcctgcttggccccaggctcagccctggagccgcctccacctgggctatttcacccgggctggtccgccacctgggaaggctcttccccgatccactgaaggagctgcctgaggtatgaacggcagagcctcccgggagcctgcccacccacactctcctcatgaggtcccctttcattctccatcttagccggagattctttccttgcttatgctgagtacaacctgcaatcattatatggatttgattatttgggtttctttctaataatctccctcatataagctccaggagggaaagaaccataactgccttgcatcccctttgcctgggacagtgactggcacagggtggatgctgaagacgttggggcagtaggaatgagtgacaatgggtcaagtgggtgcctggcgggagtccctctgggagggtgtgagtgatgacgggttgtaggttgactgtggtatagacagcaagaagaggctgaactcaagcagccattgtcaaccttttttatctcaggacctctttttactcttaaaaattagaggatggcctggtgcggtggcttacgcctgtaatcccagcatgttgggaggctgaggcggttggatcacctgaggttgggagttcgagaccagcctgaccaacatgaggcaaccctgtctctactaaaaatacaaaattagccaggcatggtggcacatgcatgcctgtaatcccagctactctggaggctgaggcaggagaattgcttgaacccaggaggcggagtttgcagtgagccgagattgcaccattgcactccagcctgggcaacaggagtgaaattctgtctcaaaaaaaaaaaaaaaaaaattggccaggctcggtggctcacgcctgtaatcccagcactttgggagactgaggcgggcagatcacgaggtcaggagatcgagaccatcctggctaacacagtgaaaccctgtctctactaaaaatacaaaaattagctgggcaaagcctgggcacagtggctcacgcatgtaatcccagcactttgggaggctgaagtgggcagatcatgaagtcaggagatcgagaccatcctggctaacacattgaaaccccatctctactaaaaaaatacaaaaaaactagccaggcatggtggcgggcgcctgtagtcccagctactcgggaggctgaggtaggagaatggcaggaacccaggaggcggagcttgaagtgagccaagatcgcaccactgcactccagcctgggcgacagagtgagactccatctcaaaaaaaaaaaaaaaaaaaaaattagctgggcgtggtggcaggtgcctgtaatcccagccactcaggaggctaaagcaggagaattgcttgaacccgggaggtagaggttgcagtgagccaagattgcaccattgtactccagcctgggtgataagagcaaaactccatctcaaaaacaaacaaacaaaaaaaccaaaaccaaacaaacaaaaaacccgtgtttgccaagagaaaaaaaagtgtagtgagatgaatgacattgttatacatttctgcatgtctttaatgtctgacttattagtagctgttggattcttgtatctgttgctataccataagccatgcagcttctgggaagatctgctatacgtttgtgagagaatgagaatggaaaagacaaataactccttagtattcatgtgataatagctttgatcttttggacttcctgaagggacctcagcaccccttttcccccattcaaggaacccaggtcaaactttaagaactgctggattaatgaggtatttaagagacaagattgacatgcctttgttatattattattgctaatatttatgaatatttatcatatgccaggcatgtttttactcttcacaacaattctatgcagtaggcacctttagtgtcccatttgacacacgagaaactgtgattttaacacatacaatttttcgcaatgcataaatatgtgtttgtgtatacttttttcacaaagaaattggacattgttatttttgcgagaccagaatgactaaattgacaaatgtatagcctttggatggtgcagctgagctcaactccaaacagtgagtctgcaatataaaagtgccctccactactttccagagctcaattacttttgaaatctaactttgatttaaatgtatttttgagccatttcatttttaagagctcatttggagagcttaaaaaattaattaaatcttttgtctttgaagtttaattcttccacttctggcatattctctatggcttatgagaaaaattgccaatcactcgggtaatttgcacctaaaataaaggtgcagaaaagttgaaattagaagcagctagaatattagttccttggtttctcctgccagggctttggaccaaaattcacagaactttcctgtattttcacattttccttttttaggaacttctaggagaaagtggtacttgaaccaagtcctgttgaaggctctactttctcaaggcacctggtcaccaccactgtctctctgctttgaatatgggtggttaagaatgtttatgagttttaaaacatttatagcaacaaatatctatagaaagatctataggatataattttgagaaaaatggccacccttggtgttgactactatcccaatggtactgattagttgtctggttggtctttaatcgtaggggcacacctctctacaccctaagattaaaaagataaagtcattagggtgctcaagttgtgaacatctcattgatgaaggctttggctcaattgtcgatgattatgatgctgttggcctctgctttgccccacagttaaatgcattaaataaacatttctgactatcggtgcaatcatgagggccctcagcttagctgggatgaaatggcttcaaaagtaggtaaaggaactcatgttgcatttgacaaaccctagctcctacctaaaccctaatctaaataagagatttttcactgggtttctagaactgtgctcctggagggcagagatgagcacgttcatttctgtgtcttcagacctgcctgacagacagaaagtgctcagcaaggtggttttatgaacggctttcatgcctgacacggacatgccactgcttccatttacagcaagacgtgccaagttgcagggatttctcctgcagaggtatttgtggtgaggaaggaaccctcatgactgttaagtcaagaaatctacctgctgtgtgctcagccttgagtgtccataggaatgagtatgtggacaggtgagggtctccagctgtcctgcatgttggctgaagctctgttattgttttttgtttttttctgggatggagtctcactctgtctcccaagctggagtgcagtggcgcgatcttggctcactgcaagctccgcctcccgggttcatgccattctcctgcctcagcctcctgagtagctgggactacaagcacttgccatcacgcccggctaattttttgtatttttagtagagatggggtttcaccatgttagccaggatggtctcaatctcctgacctcaagtgatccaccctcggcctcccaaagtgctgggattacaggcatgagccactgcacccagctgttttgttttgttttctgagacagagattcactcttgtttcccaggctggagtgcaatggcatgatcttggctcattgcaacctccacctcccaggtttaagtgattctcctgccttagcctcccaagtagctgggattacaggcatgcaccaccatgcccagctaattttgtatttttagtagagaaggggtttcaccatatcagttaggctggtcttgaactcccggcctcaggtgatctgcccgcctcagcctccaaaagtgattacaggtgtgagccaccatgcccggccttgaagctctgttattgtgcatgagatgtctggcagccttgtcttctaagggagggccgagtagtatggtgggaaaagcataagacatggagggccaggcatggtggctcacacttgtaatcccagcactttgggaggccaaggtgggcagattgcttgaggccaggagtttaagacaagcctggccaacatggtgacaccccgattctactaaaattacaaaaactagtcggggcatggtggcatgcacctgtaatcccagatactcaggaggctgaggcaggagaatcccttgaactcaggaggcggaggctgtagtgagcgagctgagatcaagccactgcactccagcctgggcaacagagtgagactctgtcaaaaaaaaaaaaaaaaaaaaaaaaagcatgagacacggactctgagaatctgcttctatacatttactgtgagctgttatctatcgctgcaaaacaaactccccaacacagtgacttagaactattgaaaaagaccttctctttgaccaaacttgagtcaggctcccctgagtcttcttctcaaagaggctttaaccttgcctgtgaaaaccgcaaaatctcaacagaaacaattctgttcaccctcacactaggagacttgaaaacacactagcttggtttctaacagctcgaggtcatgtccctagcatgacccagctcctcttgagttcctgcctggaaaagctcagggctgccagcagaatttactgtttgagatttgcatggacccaatgactgccttgtctaacaattctctgaaaagggccccccacccactcttagtaagtttctgcttacgtgactccacccgaccccacccaagctcctcctgcttattcctcctccatcctccctcatcctccccttaaaaatgcccagtcactgctgggcgtgatggctcccacctgtaatcccagcactttgggaggccaaggtgggtggatcacaaggtcaggagtttgagaccagcctggcctggccaacatggtgaaaccctgtctctactaaaaatacgaaaattaactgggtgtagtggcacgtgcctgtaatcccagctactcaggaggctgaggcaggagaatcgcttgaacccgggagggggaggttgcagtgagccaagatcctgccactgccctccagcctgggcaacagagggagactctgtttcaaaaaaaaaaaaaatgcccagtcacctctgcatggctcagagttgagctcagcatgcactgatgtctctctcccttactggagtagtctcaataaagtccatcctgctgtctttaataagtgcctggctctatttctttttgacactgcaataaactcttattaactcacacagtttcagtggccaggaattcaggagagccttagctgggtggttctggctcaagatctctcaagatgtggaccagggctgcactcatctgaaggctcgtcttgggctggagggtcggcttccaaggtggcacactcacgtggacggcttggtgctggctgttggtggtaggcctcagtttccaccatgtgggccttgccacaagtctgagtgtccttgtgacgtggcagctggctccccccaagaatgaagagagagcaagctgggggctgcagagtctttaatgacccggccttggaagtcccacatggtcccttttgcagtgtcctgttgatttcagagattctagtctctgtggcagggactccaagggtgtggacacagaggcaggaatcactggaggatatcttggagactggctgcatgactcagcttgtaatccgtgttgtgaccttgggcaggtcactggaattctctgggctggaacaataagggtaggcgaggcctgacctgtgagggccctcctgggcctgactttaccttcttttttttttttttttgagatggagttttgctcttgttgcccaggctggagtgcaatggcatgatctcggctcactgcaacctctgcctcctgggttcaagtgattctcctgcctcagcattccgagtagctgggactacaggtgcgtgccaccacgcctggctaatattttgtattttagcagagatggagtttcactgtgttaggatggtctcgatctcctaatctcatgatctgcctgcctcagcctcccaaagtgctgggattacaggcgtgagccactgcacccggccgactttaccttctattaagcaagagagtgatgtgctgaatgaaagagttaacgtgcctacaaaagcatttctcacagagaggaactcatctgccagggtctggcccagatcctagaattgggctgcttgttttgtgggggaggggggaggggatcgcagcagctgtctgggtttcccgtcatttctcctctcacttccgaggtcagggagataggaggagacatgaacaggtggctcctgacgaggctggctgggatcagccctgatacaaagacaccaaggatttggaaatgaaaatgcaagtgggggagattggcaggctgccctcggaaggagctggtcctagttttgctcctttgaggagttttgcacctgattaatgattctgttcaagatggattaagctgctggaacctttctccatttagcagtgccagctctctcctcctcttaacgctttttttttttctcgtcccagtctcccccacccccagtttgttctcgggacaaaccatcggtctaggatgaactccgttttccactggaaggtctcaagaggctaaaggcaccccacgggcttctccccgaggaagggactgaggacagaggagggccacggttgcaatgaggacagctccggctcaaaagcgtccctggacccttgactctcagcttgtcttgtcttccttaataaatttcagtttgcgggggaggggagagggatagcattaggagatatacctaatgctaaatgacgagttaatgggtgcagcacaccaacatggcacatgtatacatatgtaacaaacctgcacattgtgcacatgtaccctaaaacttaaagtataataataataaaattaaaacaacaccccctgcagaggttacatttcccccttttcttctgtcatcttctccctttccttccagtgtcacatggggagcagcaaagcctcaaaatcatggccttataattttcgtcatcactggaatggattctcagtttcttctccattcttctccttcctgcaagaacattcttctaatatgtattgattagccatttgaaagattgctcttcctgttttttgtttgtttgtttgtttgttgagacagggtctcacttcgtcacccaggctggagtgcagtgccgtgatctcagctcactgcagcctcgacctcccaggttcgagcgatcctcccacctcagacccacaagttggtcttcctagtggacagctgttaaagtgagcttctgattggaccttcgttattttggggtgacggagagcagtaaaaacataggagagcttggtcttcgcctttgattccctccgatcctgctgcagcccctgtttttaacaccactttccccttggctctgcccgctcctccccctgccgtgtcccccccaggctccctcgccacgtttcaagttgttctttattcagctgggatccaaggatctccctccagagaaagcggatcattgccggctccttcgagtcccggagtgccaagtcctgcgcccagcacaatggtcctttatacctcgctgtgtgctctctttcctggccccagctgcccccatgccctgtttttccttactcttttctgcagtattttctttccagttgacttagttattacagtacatggaccggggaggaaagctccggaacctgggcctggcgcatggagtctgagagcaagtgtggctccctggccctgccatgaagctaccaggaggtgatcggtcacattcctacacacagagcctgggctcgctttgctttcatggcaggggacagaggcagggcttgtctcctgatagccagcttccctgtggggtcctggccctgccagcctaggacatttccacaaacagaactgagtactgagtggtgagtgggtgaggccatcatttctcaactgcagcttagcatgaagtgtaataaataagactgacacggccgggcgcggtggctcacgcctgtaaccccagcactttgggaggccgaggcgggcggaacacgaggtcaggagatccagaccatcctggctaacacggtgaaaccctgtctctactaaaaatacaaaaaattagccgggcgtggtggcgagagcctgtagtcccagctactgggtagcctgaggcaggagaatggcgtgaacccgggaggcggagcttgcagtgagccgagattgcgccactgcactccagcctgggcgacagagcgagactcagtctcaaaaataaaataaaataaaaaaaaagaataacacgtttaaaaaagaaaacagctccaattaaagggaaggggttgaggctgggcatggtggctcacatctgtaatcccaacactttgggaggccacagcctgaggattgcttgagcctaggagtttgagaccagtttgggcaacacagtgagacccctgtctctattaaaaaacaataggctgggcgcggtggctcatgcctgtaatgccagcactttgggagaccgaggcagacagatcacctgaggtcaggagttcgagaccagcctggccaacatggtaaaaccccgtttctactaaaaaatacaaaaattagaccggacgcggtggttcatgcctaataatcccagcactttgggaggctgaggcggatggatcacctgaagtcaggagttcgagaccagcctgaccgacatggtgaaatctcgtctctactaaaaatacaaaaaaaattagcggggcgtggtgttgtatgcctgtaatcccagctacttgggaggctgaggtaggagaatcgcttgaaccggggaggcgggggttgcagtgagccaagattgcaccattgcactccagcctaggtgacaagagtgaaaatccatctcaaaaaagcaaaaaacaaaaattagccaggcgtggtgatacgtgactgtagtcccagctacttaggaagctgaggcaggagaatcacttgaacctgggaggcagaggttgctgtgagctgagatcatgccactgcactccagcctgggtgacagagtgggagttcatctcaaagaaaaaaaaaagcacaacaacaatagctgggtacagtggcccacacctgtaatcccagcactttgggagactgaggcaggcagatatttgaagccaggagttagagatcagcctgaccaacatggtgaaaccccatctctaccaaacaaaaaatacaaaaattagctgggtgtggtggtgagcacctgtagccccagctactcaggaggctgaggcagaagaattgcttgaacccaggaggcagaggttgcaaggagccgagattgggccactgcactccagcctaggcaacagagtgatacaccacctcaacaaataaaaaaattaaattaaattaaatttaaaatattttaaaaaccaacaataatgaataataaaataaagagaagtggctgatattggagtagatgaaagtagaggtgccaccatcagggacttggagactttctgtctgtgcgtgggatcgaccagcggcgaggtgttactaccctcccctggctgccaggggagcctggaaggcaagacggatacaggcccctttcaactcagagatttgacttcctccttccctcttgtttacaaggggctaccagaacttccaagagctacaaatggtgatgttgacatgaaacacctgctttcaattttttaaacattttaaattaagctctttaagtttgtaataaaaaaaaactagggtttcggggtagggtgtggtggctcacgcctgtaatcccagcaccgtgggaggctgaggtgggtggatcatgaggtcaagagattgagaccatcctggccaacatggtgaaaccatttctctactaaaaatacaaaaaaaaaaaaaattagctgggcgtggtggcatacacctgtagtcccagctactcgggaggctgaggcaggagaatcacttgaacctgggaggcagaggttgcagtgagccgagatcgcgccactgcactccaacctggcaacagagcaagactccatctcaaaacaaaaacaaaaacaaaaaaaactggtgtttgatttttgaggtcctggatttcaggaagaaaatgaaaaagtctaacatggacaacaaagatcacccagaacaaggaagacaaaattcgtgaccacgttggcttccctctcatttacgtactcgtgaatatttgcagggtacatcgcctgaggactaggagcaggtgactgatttgtattgcagctgaaactgtggaaagagggtggagggtgaccgagggcacgtttttaggtgtgatgctgttgatgaaaactcatctagaatgttggacacaactgagaaaacaccatcagctggatgtggtggctcatgcccgtaatcccagcactttgggaggctgaggcaggaggatcacctgaggtcaggagtttgagaccagcctgaccaacatggtgaatgaacccctgtctctactaaaaatacaaaattagtcaggtgtggtggcgggtgcctgtaatcccagctactcagaaggctgaggcaggagaatcgcttgaacccagagaggccgaggttgcagtgagccaagattgtgccactgcactctagtctgggcaacagagagagattccatctcaaaaaaaaaaaaaaagggaaagaaaagaaaaaaagaaagaaagaaaaaacaccatcaccactaccaccgccctgggacgacaaaggcgattgtaatccaggtttaggagatggcccttgtcaggctgcctgggcggctgtaggtgcggtggataccggtaagcactgtaccatactgcatccaaaaatatttaactacgtctctaccagtcgttaaatagatgctgctccatctctccccacgccccaaaatctgcctcttctggcccctctctagggatctcctggagcttcttaaaatccagctgctaaagggctaagtctggcatagctggggtccaggaccttgtttcagagttaaagctggtatccgttgttagacattttgaatattgcccctgcttataccgatgactgtaatatgtgttggcagagacatctggaaggagctctgccatggcaatgcttgaaggctgatccactgaatatgagagtgagttctggtacatgggagggggggccatggcatgaaacccgttcctagacatcgaaatttgatttattaacattggcagcagatacgggccatcttgccaacaaactttctgaaattgaaatcgcatgaaactttcctagttcctgctagtgccacatacgcccttttctttctaaggcagcaaattcacttaaaaataattaagaaaagattgatgggattttggaattgtaatgaaaaatatgatctcattagtaagtcatgagtcagggccaggcactctgtcagatgtacgcacttctgcataattagaagctgatgcaaggagaactaataatggcatgaattaaaaaattaaaatggtttccctttatacttttttggctgtgctgaaattcttccttttgcaaagattcagaaagagatctctttcaaaagaccctatcacatgcaactgagttgatgaaaaagaaaatggcggtgaaagaatggaaagggaggctgggggtgtggctcatgcctgtaatcccagcacttcggaggccaaggtgggtggatcacctgaggtcaggagttcgagaccagcctgaccaatatgatgaaaccctgtctactactaaaaatacaaaaattagccaggcgtggtggtgtgagcctttagttccagctacttaggaggctgagacaggagaatcgcttgaacccggggaaggcggaggttgcagtgagccgtgatcgcgccattgcactccattttggatgacagagtgagattccatctcaaaaaaaaaaaaagaattgaaagggctaaatggatttccactaaatccgccgggaattctcatttaggccaccagtccagggtgagaactgctgtaattcacttgtcttcaagagggtaaatacatacctgagggggataggttttgaaaagagccactagacgaatcatgtaaatgtcacataatctctgacttaaccacagaatgaataaaacagttaccctgcagaagcagcattcatgcttttcgaggctgtagtattcatgcttttcgaggctgcagtgagtttggagtgagacacagcgggcagcacccttatctctgccgctttgagtggggtgaccctgactgactgaattagtttaagccgtgatttactcatttgtaaaatgagaataaggaaactagcctctcaggtttagtacaagaatgaaatcacataacattcagagggcaggcattcattaaaaattatttatcccttcatgaaaaatattgcagaggaaacaaacaaacaaataaaatgtatctccccccccaccttttttttttgagacagagtctcactctatcgcccaggctggagtgcagtggcgtgatctgggctcaccgcaacctccgcctcccagattcaagcgattctcctgcctcagccttctgagtagctgggattacaggtgcgcgtcaccacctctggctaatttttgtatttttagtagagacggggtttcaccatgttggtcaggctggtctcaaactcctgaccttgtgatctgcccgcctcggcctcccagagtgctgggattacaggcgtgagcaaccatgccccgccttttttttttttttttgggacggagtctcgctctgtggcccaggctggagtgcagtggtgtgatctcagctcactgcaacctctgcctcccaggctcaagcgatcctcccacctcagcctcccatgtagctgagaccatagttgtgcaccaccatgcctggctaattttttgtatttatggtagagatggggttttgccatgttggccaggttggtcttgaactcctgagctcaagctatcctcctgctttggtctcccagagtgctgggattacaggcgtgagccagtgtgccctgccatcctttcccttttctttaggtaccttactttgttgacatttgaaagtagaacattggccgggcacggtggctcatgcctgtaatcccaagagcaaaactccgtctaaaaagaaagaaagtagaacatttttcccttatttttttttttttagatggaatcttgctctgtcgcccaggctggagtgcagtgcctggatcttggctcaccgcaacctctgcctcccgggttcaagtgattctcccacctcagcctcccgagtacctggaattacaggtgcgcatcaccacacccagctactttttgtatttttagtagagacggggtttcaccatgttggtcaggctggtctcgaactcctaacctgaagtgatcccctggcctcagcctcccaaagtgctgggattacaggcatgagccaccgcacctggcgaaggtcttgaccattaagtgaggagattaaacttcctttggttgggagtcatggaagattttggagcaggtaaatgacagagattcattttgaagtagtgcctacaaaatgacatggaggcagaagaaacagtgggaagactgtagtccaggaaagaaatcatggaggcctgaatgggatgatggtaatggacatagcagggaaaagggagataagagacgtagttgaagcagacgctatgggacctgggaactgagaaacacccaggccctcataagctccccagagagatggaatctgatgctaatgtcactcttccagacattatcccaaaagagttggaacctgctgggaacctgatgctaggccaggtaattccactgcatttcccatccctgtcctctccaccacccagaatgtgcaccctctctctgtctcctgctggtgtcgcttcccttcccttgacgtgcttcccgtcaggacccctcctctctttccacagagtcttctggctaaaacccatcacctcccatgtgccaagcactataccaggggctctgcacacatgatctgatgcaaaacctttttttaggccgggcgcggtggctcacgcctgtaatcccagtactttgggaggccgaggcgggtggatcacctgaggccaggagtttgagaccagcctggctcacgtggtgagacccccatctctactaagaatacaaaagttagccgggcatgggggcgggcgcctctaatcccagctacttgggaggctgaggcaggagaatcgcttgaatccgggaggcagaggttgcagtgagtcgagatcacgtgagactttgtctcaaaaaaaaaaataagtaaataaaaatataaaacctgtttttagtggaaggctccctccagagctgtgctgcatggcggtggtttgttgatagaaactccctgcacaaggacttcaaatcagtatcctgttagttccttgttacacaccagctttttcaaatcatcatgtcaccttggtgtaaaaccccacatgctctttttttttttttgagacggagtcttgctctgtcgcccagactggagtgcagtggcgcgatctcggctcactgcaagctctgcctcctgggttcacgccattctcctgcctcagcctcccaagtagctgggactacaggtgcccgccaccacgcccggctaatttttttgtatttttagtagagacggggtttcactgtgttagccaggatggtctcgatctcctgacctcatgatctgcccgcctcggcctcccaaagtgctgggattacaggcgtgagccaccacgcttggccaaatcccacacactcttgcacagtttttctttctgtttcattacttctcacctctcctccacgccgtctacccaagtcctggtcacggccatatttattgaaggttctggcatgggtcgtggcagtctttcattctagcccacgtccccatcatcctcagtgactgcagtgcccatttgaataatcggcataaaactctagtctcaagcttccttcacctccagctctgagtcttcacctcctttctccttgctccacctgttccaatggtacacctaagccttgccattgctaggactacagatccgtatcagaaatacattcttggctgggtgcagaggcttgcacctgtgatcctagcactttgggaggtcgaggcattgggatgcttgagctcaggaggttgagacactgtctctacaaaaaaatacataaattggccaagactggtggctcacacctgtaatcccagcactttgggaggccgaggagggcggatcacctgaggtcgggagttcaagaccagcctgactgacatggagaaaccctgtctctactaaaaatacaaaattagccaagcatgcctgtaatcccagctactcgggagtctgagacaggagaatcgcttgaactcgggaggtggaggttgcaacgagccgacatcatgccattgcactccagtctgggcaacaagagcaaaaccccatctcaaaaaaaaaaaaaaaaaaatacaaaaattagcggggcatggtggcatgagcccgtagtcccagctacttgggaggctgaggcaggaggttggcttgaacccaggaggtgaaggttgctgtgagttgggatcgcgccactgcacgagccagttttgagccagaccctgtctccaaacaacaacaacaaccaaaaaaaagaaaaaaagaaaaaacctctcaaactccaccttctcatttttcagttccttcaggctaccaccacctccacaaccacgctgaatagaagtggtgagagtgggcatctttcctcattcctaatttcaaagggaaaaatgttcacatttctatctattttctttttcttttttttttttttgagacggagatgcactctgtcgcccaggctggagtgcattgggtgatctcgactcactgcaacctctgccccccaggttcaggcgattttcctgcctcggcctccccagtagctgagattactgacgcccaccaccacgcctagctaatttttgtatttttcatagagacggggttttgccatgttggccaggctagtctcgaactcctggcctcaggtgatccaaccaccttggcctcccaaagtactgggattacaggcgtgagccaccatgcccagccattattattattatagttactattattggagacacagtttcgctcttgtcacccaggctggaggcaatggtgtaatctcggctcactgcaacctctccctcctgtgttcaagcgatcctcctgcctcaaaatcctgagtagctgggattacaggcatgcttcaccatgcccggctaattttcttttctttttttttttgaggcggagatgcactctgtcgcccagcctggaatgcagtggcgccatctcagctcactgcaagctccgcctctcgggttcacgccattctcctgcctcagcctcccgagtagctgggactacaggcgcccgccaccacgcccggctaattttttgtatttttagtagagacagggtttgaccatattagccaggatggtctctatttcctgaactcgtgatccacctgcctcggcctcccaaagtgctgggattacaggcgtgagccatcatgcccggcgaagtcaggctaatttttgtattattagtagagatggagtttcaccatgttagccaggctggtctcaaactcctgacctcacgtgatccactgacatcagcctcccaaagtgctgggattacaggcatgagccactgtgcctggttatagttctttttttctttttttagactgagtttctctctgtcacccaggctggagtgcagtggcacgatctcagctcactacaacctccgcctcccaggttcaagcaattcttatatttcaagcgattcccagcttcccgagtagctgggattacaggcgcccatgaccatgcccagctaattttggtatttttagtagagacagcgtttcgccatgttggccaggctggtctcgagctcctgacctcaggtgatccacctgcctcggcctcccaaagtgctgggattacaggcgtgagccactgagcctggcccatatttctctattcagtatatttgcagaggtcaattttattaaatattttaatgcatctattgagatggtaacataattttctcctttattttgctaatgtgctgaattacatttttttagtaaaccaatttaacattcatagcatacacgtaaattggtcacgctgcattagttttcttatacatttgtagaactggtttgcaatatgttatttggcatttctgcatctatgtttatgaatgatattggcctgtaattaaattttttttaagtaatatccttgacaggttttgctacaaagttatgatagcctcataaaatgtactttgtttcacttctctgggagagtttgtttgagattggttttagttcttccttacacgttgataaaatttatagaaaaagccatctggtcttagagttttctttgggggaaggttttatattacggatttaacctcttttatagttataaaataattcaggttttctgtgtctttttgtgtccattttgtttttagtaaaaattttcaatctttacataaagtcatttaaagtgtatacctatttttttttttgaatatctgcaagatctgtagtgatgtctcttttttcattccaaacatatttttttggttcctcttctccttttttcttgagcagtttcatcagagatttatcaatttaatttttttttttttgagatggagtcttgctctgtcacccaagctggagtgcagtggtgcgatctcagctctctgcaaactatgcttcctgggttcaagggattctcctgcctcaccctcctgagtagctgggattacaagtgcacgccacaacacctgtgtgccaccacacctggctaatttttgtatttttatttatttatttatttttgagatggagtcttgctctgtcgctcaggctggagtgcactggcgcaatctcggctcactgcaacctccgactcccgggttcaagcgattctcctgcctcagcctcctgagtagctgggattaccagcgcgtgccaccatgcgcagctaatttttttgtatttttagtagagacagggttttaccatgttggtcaggctggttttgaactcttgacctcgtgatctgcccgcttcaggctcccaaagtgttgggattacaagcatgagccaccgcacccagcctagtattttttttaaaagaaccaatttttggccaggtgcagtggctcacacctgcaatcccagcactttgggaggccaaggtgggaagatcacttgaacccaggagtttgagaccagcctgggcaacacagtgagacttcttctctacaaaaaatagaaaaattagcttaacatggtgatgcgagcctgtaactccagcttcttggcaggctaagatgggaagatcagttgagcctgggaacctgggatgttgagtcggccatgagctgtgattgtgccacctcactccagcctaggtaacacagtgaaacactatctcagaaaaaaaagaaccaattttttgctttactgattttctctattttctgtctgtttttatatataattatatatatatatataatcatcaatatatgcttttattgactgggcgtggtgactcatgcctctaatcccagcactttgggaagccgaggcgggtggatcacctgaggtcaggagttcaagaccagcctggccaacatggagacaccttgtctctactaaaaatacaaaaattagccaggtgtggtggtgggcacctgtaatcccagctacttgggaggctgaggcagaagaatcgcttgaaactgggaggtggaggttgcagtgagtggagacagggccactgcactccagcctgaacaacagagtgagactccacctcaaaaaaaaaaaaaaaaatatatatatatgcttttatgtatattgttattattatagagatagagtctcgctctgtcatgcaggctgaagtgctgtggcacaatcatggctcatttcagcctcaacccgccgggctgaatcgattctcctttctcagcctctcgagtagcagggaccacaggtgccacacctggctaatttttttatttttggtagggacagggtttccctatgttgccaaagctagtctcaaattcctgggctcaagctgtcctcccacctcagcctcccaaagtgttggaattacagacatgagccaccatacctggccattagctatattattttcttccttctactttcatttagtgttttctgctactcctgttctaacttttgagatagatgcttaactcattaactttcagtctttcttctttattaatatagcattttctttttttatttttaagccagtcaaattttaatatagtactttaggctatagattcttcccctaaataatgctttagcctacatctcaccagctttatatgtaatattttaattgtcattcagtttaaaatattttatgatttcagccgggtggtggctcacgcctgtaatcccagcactttgggaggccgagtcggggggaatcacttgaggccaggagatcgagaccatcctggccaacatgatgaaaccccgcctctactaaaaatacaaaacttagccgggcatggtggcgggcgcctgtagtcccagctactcaggaggctgaggcaggagaatcgcctgaacctggggaaggcggaggttgcagtcagccgaaattgtgccactgcactccagcctggcgacagagtgagactccgtctcaaaaaaattaaaaaaaagagtcatttgtctcctggaagagctcaggaaatgttagaatctctcctttgcttctctccctcttgctgtgctgttcctattacattgtaattatttgtttacatgtctgttccaccttcccaagtgagttatgtgagggaaggcttcatgtcacgtcatctggtatcctcagaagatagcaacgtgcctggcacatagtgggtgaataaatggactctagtcctgtttcataaatagtaattgaatgaatctgaaaaaaatcaatctctataggcaaaaactcaatgccatatatctatggaatttttgctttaattatggttaatgatgctttaactgatccttgattggcccaaatgattagaaaacagtcataaacagtggctcatggctgtaatcccagcactctgggtggctgaaagaggtggatcacttgaggtcaggagtttgaggccagcctggccaacgtggtgaaaccctgtatctactaaaaatgcaaaaattagccaggtgtggaggtgggcacctgtaattctaggtactcgggaggctgaggcagaattgcttgaacccaggaggcagaggttgcagtgagccaagatcgtgccactgtactccagcctgggtgacaacacgataccctgtctcaaaaaggaaaagacgaaagaaagaaagggaaagaaagaagaagaaagaaagaaaatattcatagaggtaagcctgagcttacccttagcaaaactgcgaagctggtgacatctgtctttgttttttgtttttgtttttttggttttttttttttttttttttgagagggagtctcactctgtcacccagggtggagtgcaggggggagatcttggcaacctccacctcccgggttcaaccaattctcctgcctcagcctcctgagtagctgggaatacaggcatccgccaccacacctggctagttttttaatttttagtagacacagggtttcaccaggttgaccaggttggtctcgaactcctcacctcaggtgactcgccacctttggcctcccaaagtgttgggattacaggcatgagccaccatgcccagccgtctgtctttgtttttgaacctgcctggcggcatcctactcttgctttctgtggccgtcactaatccaggtaccttttccatcctcagcttgccctcaaggctggaaaacacaacatgtggattcagctttaaggctgaagagcatccaacactctggtcagtcatgtgtcctggatggagatgggagctctgaatgcttctttccttaatttagcaaaataagaggacagaaagaaatatttatcaggattacaaccgccactatttattgagtcagacactgttaatcatttacgtgcattgttgcatttttgcactcttgacaacatttctatgagagagatactacgttgttcccattgctgaggttaggaagtaaaggctgactagatatgcccacagttcggcatctaacaaatggcaaagctggaattcaaacttaccttctctggtttaaagtgggtgcttttttttttttttttttttttttgagacagagtcttgctctgtcacctagactggagtgcaatggcacaatctcggctcactgcaacctccgcctcctgggttcaagtgattctcctgcctcagcctcccgagtagctgatgggtccggaattggtgggttcttggtctcactgacttcaagaatgaagccgccaaccctcgcggtgggtgttacagttcttaaaggcggcgtaaccggaatttgttccttctgatgttcagatgtgttccgaatttcttccttctggtgggtttgtggtctcactggctcaggagtgaagctgcagaccttcgcagtgagtgttacagctcatacagacagtgtgaacccaaagagtgagcagcagcaggattttttgcaaagagtgaaagaacaaagtttccacggtgtggaaactgacccgagcgggttgccactgctggctcgggcagcctgcttttagtctcttatctggccccacccacatcctgctgattggtagagcccagtggtctgttttgacagggcgctgattggtgcgtttacaatccttgagccagatacaaaggttctccaccttcccaccagattagctggatacagagttaagacacacaggttctccaaggccccaccagagtagctacatacagagtgtcgactggtgcattcacaaaccctgagctagacatagggtgctgattggtgtgtttacaatccctgggctagacataaaggttctccacgtccccaccagactcaggagcccagcggcttcaccccgtggatcccgcaccggggctgcaggtggagctgcccgccagtcctgcgccgcgcgcccgcgctcctcagcccttgggtggtcgatgggactgggcgccgtggagcagggggcggtgctcatcgaggaggctccggccgcacgggagcccatggagggggtgggaggctcaggcacggcgggctgcaggtcccgaggcctgccccgcgggaaggcagctaaggcccggtgagaaatcgagcgcagcgccggtgggctggcactgctaggggacccagtacaccctccgcagccgctgacccgggtgctaagcccctcataagccggccggctgcgccgccaagcccacacccacccggaactccagctggcccgcaagcgctgggcgcagccccggttcccacttgcgcctctccctccacaccttcctgcaagctgagggaaccggctccggccttggccagcccagaaaggggctcccacagtgcagcggtgggctgaagggctcctcaagttccaccaaagtgggagcccagacagaggaggcgccgagagcgagcgagggctgtgaggactgccagcacgctgtcacctctcactgagactacaggcgcacgccaccacgccccgctaatttttgtattcttagtagagacaaggtttcactatgttggcctggctggtcttgaactcccgacctcaggtgatccgcctgccttggcctcccaaagtgctgggattacaggcgtgagccaccgcaccccactaaagcaggtgcttttaaccactattccaaattcccaaatgtacagaccacggcattgtctgaactggaaggcatggtcaaaactttagtctgaattattaaaatcttattgaagaatttaataactgaggaaaataagcagagaaaatatttctggacaaagggaccaatttgttgcttctaaaattatatcgcatgatattttgtttactaatatttgaatttggcaattgtgaggctaagaaaatggaaatggggctgggagctgtggctcatgcctgtaatcccagcactttgggaggcagaggtgagcagaccacaagttcaggagttcgagaccagcctggccaacatagtgaaaccccgtctctactaaaaatgcaaaaattacccgagcatggtggcgtgcacttgtagtaccagctactcaggaggcagaagcaggacaatcgcttgaacccgggaggcagaagttgtagtgagctgagatcatgccacggcactccagcctgggcaacagagtgagactctgtctcaaaaaacaaacaaacaaacaaagaaaatggaaatggttaagttaggggagctgtagaccaagtcagtactccagtgatcagacgaagtagccctcctcagtttttttttttttttttttttgagatggagtctcactctgttgcctaggctggaatgcagtggcatgatctcagctcactgcaacctctgcctcccgggttcaagtgattctcctgcctcagcttcccaagtagctgggattacaggtgcccgccaccacgcccagctaatttttgtgtttttagtagagatggggtttcaccatgctggccaggctgttctcgaactcctgagctcagacaatctgcccgcctcggcctcccaaagtgctgggattacaggcatgagccaccgcgcccggctcaccatgttggtttctaagatttcctgtttgtctcttgttccttgtgtaagagtaggtactatcataaatcctgcccttagggcaaacgaccttgaggtcatcatacttcagttcctgcatagcccttctgaaccacccctcccctatgctacataagcccggagtaggggagtggcagcctgcggatccaccacctccattagcttttgtttataagtctccattaggtgattccggctaagaaacaggatttgtcagcctctttctttggcctctcagcttcctgggactctggggcaggtttggatagtcctgccaaccgcagaacactcatcaaggtgggagtggaaactgctgcagagaagaatcccatttgtgtttgtgctcttacccagggctgggatgtgaggcccctcctcagtttttaacaggacaaggccagaaatgtatcaagaatcattcattcttctgcagcaaaacaaacctcccactgctccctggagaacaagacagtttcagaagggaaaagataagagttcttctgagctttcaaagaacttaatagggaggcaaaaaagaaaacaaacaaacagaaaaacaatgctttcataaagtgaaggaaaaaaatctctggctaatctgattgttaaagtgattgtaccgaaataaaaaatctctcaaacaggccgggcacggtggctcacgcctgtaatcccagcaccttgggaggccgaggcgggtggatcacgaggtcaggagatcgagaccatcctggctaatacggtgaaaccccgtctccattaaaaatacaaaaaattacccgggcgtgttggtgggcgcctgtagtccgttgtagtcccagctactcgtgaggctgagacagaagaatggcgtgaacccgggagacggagcttgcagtgaactgagatcgtgccactgcactccagcctgggcgacagagcgagactccgtctcgaacaacagcaaaaaatccctcaaacatttgatcattcctactcttggaactaataatattaaatatatatttgtaacatgattgttcatattttaattataggttaacaatggtgcgttcatacggtgtttgcttgcttgaagaagttgctttataattaatatagtattagcatataatttgaaacaactggctgggtgcggtggctcacgcctgtcatcccagaactttgggaggccgaggcggacagatcacctgaggtcaggagttcgagaccacctggtcaacatggtgaaaccccgtctccactaaaaatacgaaaattagccgggtgtggaggtgcatgcctgtagtcccagctcctcgggaggctgggcaacaagagcgaaactccatctcaaaaacaaaacaaaacaaaacaaaattttaaaaaaagcatgaaagatgtaattttttaaataaataaaattaaaaataattgcctgttgctcaggctggagtgcagtggtgcaatctccactcactgcaaccttcgcctctatggcaagaacttcggaagggcacaagtcatattgcataatgagcgtgacaagcctcagcttgtttatgccaatatttctgacactcacttgaccatggaggtttctgtgaaggccacagccaggtacccagtaggccattagtgagcatctgtggtgaacaaatgaaccttgcaggccacacactgggagatgctgctgtaaggcagaggatggtctacgataatattacatacaaaatgcaggagatactcttttgaataggtggcgtcttactactccttcaagccacatacaaggttagcatccccaccaagtcagccctactttgtataggctcagtttcactgaatggaaactccttgagggaagggattaatgaatgcttactggatgaataaattaacaaacgaatatcagaattgcttgaacctgggaggtggaggttgcagtgagccaagatcactccagcctgggggacaagagcgagactttgtctgaaaaaaacaaaaaaaaagtaaaaaaaaaagtaagcatgttgggcagtagggagtgggaactgaaatgaaaagctatgtgtgctcatattggccaacatcttaagtagaattagaatagtacggttccaccaaagctgtcttctcagacacttgatttaaggtagtctcttccttgagatggcatccatttcaggacagaattagaatattagaggaactaaagttaattattaaagccttaaaaagtatggggctggggctcaccctaaccagtggcatggtctttatttttttatttaattaattaatttatttttttgagacagagtcttgccctgttccccaggagatggagtgcagtgacacgatctccgttcactgcaacctccgcctcccgggttcaagagattctcctgcctcagcctcctgggtagctgggattacaggcacgcaccaccacgcccggctaatttttgcattttttttagtagagacaaggtttcgccatgttggccaggttagtctcgaactcctgacctcaggtgattcacccgccttggcctcccaaagtgctgggattacaggcgtgaaccaccacacccagcctatttttttattttttatgttggccagactggtctcaaactcctgacctcagggaatccacctgccttggcctcccaaagtgttgggattacaggcgtgagccaccacaccgggctggcatggtctttattaacaatgaggacaggtggggcatggtggctcggcctgtaatcccagcactttgggaggacaaggtgggcggattgcatgagactaggagtttgagaccaacttgagcaacatggtgaaaccccatctctacaaaaaaaacaaaaaaaacaaaaattatccaggcgtggtggcgtgcacctgtagttctagctacttgggaggctgaggtgagaggatcttgagcccaagaagtcgaagttgcagtgaacagagatcgtgccactgcactccagcctggatgacagagcgagaccctgtctcaaaaaatgtatatataacaacgacgctgttatttctgtatgggagatgtctctgtccccagtctgctagaagagaactggccaaaatatattaattgaatgaaataggaattacgggaatttggaaatggagctgaagaaaatgcagccagtgctaatccaaggctaagtattctccacggggaagatgactacgtgggggtgtgagttccacgaagacagagcagccgaggaggaaggaaggaccaaggccaggcctggatgccactgcagggagggtggccttttcattttctgtgagtgtttctcattagtcaaaaaatgtgcctgggtttgtatcctcttgtttaccagatgaagggttgccctggggggcctctgggctctgggctacagtaatgattgcggtgaagaggatgacaatttacatttctatggttctccctagaggactcagcctggggaggagtgttctgactacattttagtgttagacgatcagattaaaatgaaggtcagagaatctcacagaatgcgaaagggaagaccggctggagaagtgggtggggaggatgttagggtggattgtttctaaccctctcttccctcactgactcttttgcaggtcagcactccgcccaccaactgcctagttctctgctcactgcaacctccgcctcccgggttcaagcaattctcctgcctcagcctcccaagtagctgtgactacaggcgcccgccgccatgcccggctaatttttttttttttttttttttgtattgtagtagaggcagggtttcaccgtgttgtccggctaatttttgtgtgtgtgtgtgtgtgtgtgttgtagtagaggcagggtttcaccgtgttgcccaggctggtctcaaactcttgagcccaggcaatccgcttgccaccgcctctcaaagtcctgggattacaggcgtgagccaccgcgcctggccttggcttcttagtttgtggtcatgtttttttcaggcaaacgctgaagtcgtggcacttcaacatcagtgggaagggagcgctttgtaacaacagggaggaaaactgacttgtaaatacaagagctcaggaaccccatgcggccacatttaaataccagcgggagaagtaggggtgttcccttctgcttggacctccgctgcctcagctggagagtctgtttgtccagcggacagaagagggagaagtacacagagctgatacagcttctgatcgcgcaaatgaagagccataaatatcttagccgggcgtggtggcgcgggcccgtactcccagctcctgcggaggctgaggcacaagaatcgcttgaacccaggaggcggaggttgcagtgagctcagattgcgccactgcactccagcctgggtgatagagcgagactgtctaaaaaaaaaaaaaaaaaaaaaaaaaagaagaagaagaagagccagaaatatcaacatagaaggaatttagaacaaagcaagtcacaaaaactatagcagtcatctaacccagccttccacggggtgcagctctctctgctgcctgtgcaacccacgcttgaaggcctttattcgggaggaatttaggagctacctcccaggcagctcgagtatgtgataaaaagttccttcttagattaggccaaaatttacttcctggtaacttttaccctttggagtaataacagcgaatccattcctttttccttctacaccattgccttcctactagttgaagacagtccctagtccctgtaaacactctcttctcagaggcagggaagccagaggcaggaaacagtggctcctgagtcggggcactccctcccagcatcccaacaggacaagcatcctggcctctacgtcctgaggtcgcgttgctggccaaagtctttaggatacgcaaatataaaacaaatggtgataataacatttggacaaaatagtatcgtttcttctctattcttgtcaaacctctcaagtaaaggttatattgtgaaaaattctaaacaacgaaggcaaggcaaagatttgcaaagtacatggtaaaggtatactctccttaatgaagtggtgttcaaaagttgttttaagactttttttttttacaggtgcagtggctcacacctgtaatcccagtacttcgggaggctgagatggaaggatcacttgagcctggatgttcaaggctgcaatgagctgtggctgcactgctgcactccagcctgggagacagaatgagactctgtcttgaataataataataataataataataattgttttaagattttttattttttgagacggagtttcactcttgttgcccaggctgcagtgcaatggcacgatctcagctcaccgcaacctccacctcctggattcaagtgattctcctgcctcagcctcccgagtagctaggattagagatatgtgcctccacgcctggctaattttgtatttttagtagagacgagctttctccatgttggtcaggctggtctcggactcccgacctcaggtgatccactcgcctcggcctcccaaaatgctgggattacaggcgtgagccaccgtgcctggcctaagatttttttttttttgagacagagtcttgctctgttgcccaggctggactgcagtggcatgatctcggctcactgcaacctccgcctcccgggttcaagcgattctcctgcctcagcctcctgagtagctgggattacaggcgcatgccatcacgccggctaattttttgtatttttagtagagacggggtttcacctgttggctaggctggtctcgaactcctgacctcatgatccgccctcctcggcctctcaaagtgctgggattacaggcatgagccactgcatctggccaatattttttttttaagagcagttttaggttcacagcaaaattgacaggaagcaccagagatttcccatatatccctgtccccacacactcacagtctctcccattgtcaaccagagagtgacacatttcttacgatttttttttttttttgagacggagtcttgctctgtcgcccaggctggagtacagaggtgccatctcgactcactgcaagctccgcctcccaggttcacgccattctcctgcctcagcctcccgagtagctgggactacaggtgcctgccaccacgcccggctaatttttggtatttttagtagagacggggtttcaccatgttagccaggatggtctcgatctcctgaccttgtgatccgccctcctcggcctcccaaagtgctgggattacaggcgtgacccaccgcacctggctatttcttacgattaatgagcccaccctgacacatcatcacccaagtctacagtttacgttcgtgttcactctaggtgttttactaaatttaatggacaaataagagctaatacttctgaagtgcttactgcaagccaagcactgttcttcgtgttttgcatgtgctatgaagtaatttaatttttacaatgactctatgcattacctgatgtccccactttacagacagggacactgtttgagattggttacttgtttgagatcgaacagctgatgaatgaggcagaagtggatggagctcaggtggtctggtccagtctgttcctgtgctcttgaccaccctgctgtgctgtctctatggacggggacacagaaagagaagtcgacaagggaaaaggagaaatctcaccagcagctagggacatttagggtgaggcactgagacactgtctgttttgaaccttcaactgaaaaaaatctcatgtttgtgaagtcacagggaaaaggccattttctgtgctgccgaaggcgttccatcatgaaggacgggctaacaccaggcaccaacaaaatgtgtagctcaggagtgctatttataagaccttggcggcgcatggtggctcacgcctgtaatcccagcacttcaggaggctgaggtgggcggatcacttgaggtcaggcattcgagaccagcctggtcaacatggtgaaaccccgtgtctactaaaaatacaaaaattagccgggcatggtggcaggcatctataatcccagctacttgggaggctgaggcacgagaatcctttcaactcagcaggtggagcttgcagtgagctgagatcatgccactgcattccagcctgggtgacagtgcgagactcagtctcaacaacaacaaccaaaaaccttatcctgaggggctaagtaagaatcacacaaaagtttagttattggctgggcacagtgggtcatgcctgtaatgccaacactttgggaggctgaggtgggcagatcacctgaggtcggtagttcgagaccagcctggctaacatggtgaaaccctgtctctactgaaaatacaaaaattagctgggtgtagtggcaggtgcctgtaatcccagctactggggaggctgaggcggaagaatcacttgaacccgggaggcggaggttgcagtgagcagagattgcgccattgcactccagcctggggaaataagagggaaactccatcttaaaaaaaaaaaaattagttacaaacaatctcagagttggtatggtagagtggctatgatagagaaaagttaagaaaaaaaaacaaacttttggctgggcgtggtggctcacgcctgtaatcccagcactttgggaggccgacgcaggtagatcacaaggtcaggagtttgacaccagcctggcgaaagagaccagcatggtgaaaccccatctctactaaaaatacaaacgttggccgggcatggtggtggatgcctgtgatcccagctactcgggaggctgaggcaggaggattgcttgaacccaggaggcataggttgcagtgagctgagatcgtgccattattctccagcctgggcaacagagcaagactctgactcaaaaaaaaaaaaaaaaaaaagaaaaagaaaaagaaaaaaccaaactttcaacacaaggagattgattacatgaagcaagacacattctttttgttgctgttgctgttgttgttttgagatggagtcttgctctgtcgcccaggctggactgcagtggcgtgatcacggctcactgcaacctctgcctcctgggctcaagcgatcctcctgcctcagcctcccttgcagctgggattacaggcatgcgccaccacgcctggctaatttttgtatttttagtagagacggggtttcaccatgttggccaggctggtctcgaactcccgacctcaagtgatccgcccacctcagtctcccaaagtgctgggactacaggcgtgagccaccacgcctggccttaggacacattcttaaagtgggtgccaggcagtcaacagaaaaacttgctaacatttttaatttttaatttttatttttattttcagacagagtcttgctctgttgcccaggctggagtgcagtgatgcgagcttggctcaactgcaacctctgcctcccgggttcaactgattctcctgcctcagcctccagagtagctgggactacaggcacacaccaccacgcctggctactaaagttgctaacattttgccagacaagaatttcaaaagacactgggtgtggtgtctcacacctgtaatcccagcactttgggaggccagggtgggaggattgcttgaggaaggagttcgccaccagcccagacaacaaagggagaccccatctctacaaaataaataaataaaaagaatttcaaaagaatttttcacacatggcaatgtgtttgtgatatgtgggaaaaaaacaggtttcaatgtaagaataaatcactattttctcattgttctgctgagaaatgatcgtaaagatttatgccaggccgggcacggtggctcatgcctgtaatgccagcactttgggaggccgaggcgggcagatcacctgaggttgggagttcgagaccagcctgtccaacatgctgaaaccccgtctctactaaaaatacaaaaattagccgggagtggtggaacacgcctgtattcccagctactcgggaggctgaggcaggagaatcgtttgaacctggtaggtggaggtgcaatgagccacaggccactacactccagcctgggtgacagtgcgagattccatctcaaaaaaaaaaaaaaaaaaaaaaaagacatatgccaagttgtaattagtgattatttctcaatgaagtaatggtgatttgattttcttctttgagtctattgtattttttttccaaattcaacacaaaaaaggtagtaataggaaagtaaacagtatttttaattaaaaatagtaagcagaacatttcaaaataaagcacctattgggactctactgtgagaaaaatagcccatctcccatggcacctcattgtcaaagtccacaggggtctctgaaaaatggtgattatacttttgtctcactattaacacacagatcccatcagaatgcagtcattttcttgtaaaggagaaagttcttggtaaggaagccacaagtagaaatagttttccattttccttaaatttgtccttgaaagttttatacctgagtatggactctctcaagcagctttcctaaggaggtcaaaatgctgatgctgaagtttgtctctgttgccccctaggaccaccacctttatggggaccgagagtctccagggaaattctactttgtaatgagatgttttcttcctttatctgatgactcctaagctggacaaaatctgttctgtaaataaaggtggcgaatgcctcagtcggtactcctgggtcctgtttgaagcagaagaatgtgagaggctcttagtgatgcactttgggccagggtgtgtcttgtgcattggtggctcagcccggacagccggcaccccacatcagggagggctgatggcagctttctggacagcttgaggctacaggatacacatcgggtctgtgctagacctgctggtagaagaagtgctctttcacggaatggttctctttcttgaacttgcctatggcaagggcagaaaagaaacatggggtctgggcttttcaatcaggttgtatatctcttcactgatcttccttcccactctccccacccagatggcccaggcctgctcattcctcatttccaccgcgagcatcacctcgcacagtcctcaacaaccccagcctctgcccccactaacccaccctgccagctctccctcgaagacgtcctcctccatgttcatgctgacgttgcctttcttgtttgtgtttcatccacctgtaaaatacaagtttcaaggccaactcagaggacaaagaaactgcttcaggcccggtgctgtggctcacacctgtaatcccagcactttgggaggccaaggtgggtggatcacttgagttcgggagttcgagaccagcctgaccaacgtggagaaaccccgtctctattaaaaatacaaaattagccaggcgtggtggcgcatgcctgtaatcccagctactcagaaggctgaggcaggagaatcgcttgaacctgggaggtggaggtcgtggtgagccgaggtcatgccattgcgctccagcatgggcaacaagagcaaaactctgtctcagaaaaagaaaaaaaaaattagctgggtgtggtggcgcctgcctgtagtcccagctactcaggaagctgaggcaggagaatcgtttgaacctgggaggcggaggtttcagtgagctgagatggcaccactgcactccagcctggacgacagagcaagactctgtctcaaaaaaagaaaagaaaagaaaactgcttaaggttcatctttgagctggagagttagtctttaataaatgccgtcctgcagcagagatgcactgtggacacatagcaggaggtgaggaaagcaagcttgccaatggatgagtaattgaggaaaaccggggaataactaggagactaatcaaagtctgagaacatcatttaaaatgaccaagtcaaccaggcatggtggctcatgccgcccagagtttggaaggccaagacgggaggattgcttgaggccaggcgttttgagaccagcctgggcaacatcgtgagaccctacccctacagaacataaataaataaataaataagtataaaaataccacgtcaatgtgttttgcaacttacacagtgtttgtctcattgtggcaggatcctgtgctaggttgtgtatttagcagacaaaggcccaagataagaaataagcttggcagataggtatggaagaaggtcaggtggctgacaaagttcaaggtagaacagaggactcagtgcagtgggtggcagggaaaactgatgatatcagtctggaattaccagattagacttttttttttttttttttgagacgggatctcactgtgttgtcaaggctggtcttgaactactgagctcaagcaatcctcctgtctcagcctcctgagtagctgggacttcaggggcacaccaccgtgcagctttcagcccagattttcactgaagaagtgcaagtacagaaatgcaaattttagggccagcgcagtggctaacgcctgtaatcctagcactttgggaggccgaggcgggtggaacacttgaggtcaggagttcaagaccagcttggccaacatggtgaaaccttgtctctactaaaaatataaaaaagctgggcgtggtggcaggcacctgtaatcccagctactcaggagcctgaggcaggagaatcacttgaacctgggaggtggagtttgcagtgagccaaagtcgtgccactgcactccagcctgggcaacagcaagactctgtctcaaaaaaataaaataaaaaaataaaaaatgcagagatagtagaaaacccagggggtgagcaagaggaagaagggagcattaggaaaagtgtcaggtgacataaggcagccttgccctggctgctcccgttccctgacttaagcatggctggcaactttgcttcctgcccacctcttccatgaagccctctgtgaccctttggtttgaaatagctgcccaatcactctgtccatcaggttatttcatatctcagccaagcacttatcactccctgttattttcttgtttgtcagtttactccctgtctctctcaataaggatgtcagtgctctgcaagcagagaccttgggtggcagaatctagaactgcctgcacacagtacatgctcagtaagcattgctgaatgtgtctacctctcccattcatctttgaatttaactaccaagcaacatggctggatataaagaaggaaacccataagttactggcacatagtttgtctcatgcacattttgacattgaatatattaacagtgacaagtccttccctcatatacctgtcgaatgaatgtatcttgcactgttctctgacaaactgtcctattcatgctggccttgtcattttatcattctcaacacatccccacacttgcctgacttctctgcctttacacacagtgtcgtcaacactgaggcactattccttttccttctatctatggacagccaacccatgctttagattccagttcaactctcttttctttttcttttcttttttttttttttttgaaacagagaaacagagtcttgctgttgttgcccaggctggagtgcaatggcacgatcttggctcaccacaacctctgcctcccaggttcaagcaattctcctgcctcagcctcccgagtagctgggattacaggtgcacgccaccacacccagctaatttttgttttttagtagagactgggtttcacctgttggtcaggctggtcttgaacttccgacctcgtgatctgctcgcctcggcctcccaaagcgctgggattatgcttcatcatcctattgggaacagactccacagctgggtgcaggagtggtctgtggctcctgtctgtcggatgacagcttcacgttacccccagcacagaggtggcactgggataggcacacgactctgcaaagccaatcgggtaccaggagaattttgctgagggcgttgggattatggcaggtgctcctccctgtggtgcttgatttgagagcattaaggcctggagctaagtagccactgatatggtttggctctgtgtccccaccgaaatctcctgttgaattgtaattgccagcacgggagaacgggcctggtgggaggtgattggatattggggatggacgtcccccttgctattctcctgatagtgagggagttctcgcgagatctggttgtttaaaaacgtgtagccgccccccaccccccacccccccgcgccccgccccacgctcttcctccttgtgcagcttccctttcgccttctgccatgattggaagcctcctgaggcctgtgcagccacgtgagtcaattaaacctcttttctttataaattacccagtcccaggtagttctttatggcactctgagaacggactaatacagccaccttgtgagcctaagggagaagcgtgctggggacgtgaccctcccccaacaaactcctgcctcttgtggagggaatggcatgtttgaaggaaaaggtctggcatttaggggaaatgcaagaagttgtgtgtatgaatgtagagggaagaggcaggtgggaatagggtggggagaggctctatatgaaggaagagaggtaggcagggtcctgatcatataggactttgaggaagccaaaggaccttgtccctttcttcccctgagcttacattctgggagctccaggttagacaggaccacacgaggcctttgagctcctgggggaatacagatatgttcttgggtgtttgaaagagttctatgagaattttgcaattttgtattttagttttgaaaaacaatgtgacttttacttttttttaatttaaaattttatttttatttatttggcaaataaacattgtgtgtgtgtgtatgtatatatttatttattgagacagggccttgctctgttgcccaggctggagtgcagtggcgccatctcggctcattgcagcttcaacctcctgggctcaagtgatgctcccacttgaaccacaggtgtgcaccaccatgcacagctaactcttttattttttgtagagatggagtcttgctatgttgcccgggctggtctcaaactcctggacttaagagatcctcccaccttggcctcccaaagtgctgggatcacaggtgtgagccaccaaccctggcctaaaaattgtatatttttattgtgtataccatgatgggtttttttgtttgtttgttttgtgagacaggttttgctctgttgcccagggtggggtgcagtggtgcgatctcggcttactgcaacctcctcctcttgggttcaagcaattcttgtgcctcagcctcccaagtgctgggactacaagcgcatgccaccatgcctggctaatttttttttttttttggagacaaagtctcactctgtcgcccaggctggagtgcagtgatgcgatcttggttcactgcaatctctgcctcctgggttgaagcaattctcctgcctcagccttccgagtagctgggattacaggtgcacaccaccatgcccggctaatttttgtatttttaatagagacggggtttcaccatgttggtcaggctggtcctgaactgctgacctcgggcaatccgcctgcctcggcctcctgaattgctgggattacaggcgtgagccactgcgcctggccaatttttgtattttttaagtagagacagggttttgccaggtttgccaggctggtcttgaactcctgacctcaaacgatccgcccacattggcctcccaaagtgctgggattataggcatgagccactgtgcctggcccaccatgattctttgaatagaatggctacatcaagcaaactgacatatgcattacctcctgtacttacttttgtgtgtgtgtgtacaatacattttcttttttctgtgagatggagtctcgctctgttgcccagggtggagtgcagggtgcaatgtcggctcactgcaacctctgcctcccaggttcaagcaattctctgcctcagcctcccacgtagtgggattacatgcgtgcaccaccatgcccggctaatttttgtatttttagtagagatgaggtttcagcatcttggtcaggctggtcttgaactcctgacctcacgatccacctgtaaatccaggttggattacaggcgggagccaccgcctccggcccacaatatattttctaaactagctggtgatcacccatgactgagtgtccgcataccatatcaggcttgcgcatgtgtcctggtactagttgttcatttgccctcttccctctctggtctccaccacccacctttctccacccggcagaaactgatcagtatggacggaatccacaggctcccttgccttttgctttctggtgtgaggagccctggcgggaggggacgacagcaagagtgaggcctctcccagcgagcctggccctggctgtctgtgcccctagaccaaaggtcacatgtctcacggtggcttctctccttgactccctcctcctgtttgggggcccctcaccgtcctgtgtcctgtaagcctagcagctcctctgccatcagcccctggtttccgcaccacctcagcacatgccaggcgtctccttgtaagtcaaccctcccccgagtacccaaggctcggtgagcccgccaccttctgttgggatcctgactgatacaggcatcgggtaggatgacttttacttttccgcattaattacaagagagagatagttggactgaatctgggaaagattcattcaaattgaatgaaggctcgatgacatcaagagccttgtgcctcgcgccgttcacataaggatactgagcagtttgaatggagaaaagcagtagaaaaaccgacttcgcacagcagttgccggtggctgccaggcagtggcaatctgtactgtgttcttgtatggagagtgatttcatttcagcaaaacaacatcaactgttacattcagttagagctgttaatttgacttctatttgccttatacttgtgtctgtatattatttgcaaattgtttggttttattatagtataaaattcataatcttttttttttttttttttttttgagacggagtctcgctctgtggcccaggctggagtgcagtggcacaatctcggctcactgcaagctctgcctcctgggttcaggccattctcctgcctcagcctcccaagtaactgggactacaggcgcccgccaccacgcccggctaattttttgtatttttagtagagacggggtttcactgtgttagccaggatggtctcgatctcctgacctcatgatccgcctgcctctgcctcccaaactgctgggattacaggcgtgagccaccgcgcctggccaaaattcacaatcttaagcgtttatacctaggttcatgtttattactttttttgtgtgtgtgtgaggtagagtttcactcgttgcccaggctggagtgcagtggcgcgatctcagctcactgcaacctccgcctcctgggttcaagtgtttctcctgcctcagcctcctgagtagctgggattgcaggcatgcgccaccacgcccagctaattttgtatttttagtagagatggggtttcaccatgttggtcagattgatctcgaactcctgacctctggtaatccacccgcctcagcctcccaaagtgctgggattacatgtgtgagccaccacaccttgcccatgtttattacttgtaaatggtactatgataaaataatttgattttttaagaatggctccatacatccctcaacttgagaacactggtctagtccaacatttcctctgctgcggaaatgcttctgatacaccagaggctccatatccatttgtcaaaaaggtttgacattaaactaaagttaaacatttccaatcatgcatcctgattttgcccactatagtgaccctcatgaaaagtccaagctcttttctatggaacagttttccatcgctgatatcccataatagcactcccatctctccattcctgtttctcaaatgcttaccccaatcccgggtctcaatgcaaacgccctcctccgtgaaggagtccttcacgttcttcccctgaccagaagcggcctcccctcactggaactttcacagtgaatcatagcccactgtgcgtgccggttgccggtgcatagcttcctttctcctgttagtttttgcttttggaaagcaggatttgttattcattcatttgtactcactgtagccctgaccagtgtctaacatatatagatgtttaataaatattgaattaaaggaatcagtgaaaagtgtaagaatatattacacacacacacaaatgaaaaatagaaaagttctgcataaatgtataatacacatttgcctctttttttttttttttgagatggagtcttgttctgtcgcccaggctggagtgcagtggtgtgatcttggctcactgcaacctctgcctcccaggttcaagtgattctcctgcctcagcctcctgagtagctgggactataggtgcctgccaccatgcccggctaatttctgtatttttagtagagatggggtttcgccatattggccagactgatcttgaactcctgacctccagtgatctgccttggcctcccaaagtgctgggatgacaggcgtgagcccccgcacccggcctgcctggtatttttagtattcgttctctctgaaccaggagcccgcttcaggctgccgtctagcagcaccactgaatgctgtgtgttaacctgcagacttcaacttctctgtgctagaggccaccttctgtttgtaaagcgccagaatttccttgtccctcacaccacttctctaaatggagtctaacatcagcctctttttttttttttttttttgcaagacagagtttcgctcttgttgcccaggctggagtgcaatggcgcaatctcggctctctgcaacctctgcctccctggttcaagtgattcttctgcctcagcctcccgagtagctgagactacaggcgtgcgccaccacgcccggctagtttttgtatttttagtagagatggggtttcaccatgttgaccaggatggtctcgaactcctgaccttgtgatctgcctgcctcggactcccaaggtgttgggattacaggcatgaatcactgcgtctagctgagttcaaacaattctcctgcctcagcctcccgagtagctgggactacaggtgcccgccaccacacccggctaatttctgtatttttttttttttagtagagatggaggtttcaccatattggccaggctggtctcaaactcctgacctcaagtgatccacctgtctcagcctcccaaagtgctgggattacaggcataagccaccacaccctgcccaaaactcggaactttaaaagaatagatagggagtcactgattatttattttatagcagatttttaaaaatacctggtttcccaagttatttgaatcctcattgattttaaggctggatagtccttaaacattatctataatactttaacacttaatgttttacaagtgaagaaataggccatctgtttgttcagtttattccgggactcttcaaccctgtgggtagaaaatcacagagcaaagcagatgaatgtcattgccaagcaatggatgtcattgctaagttgaaggccggcttcatttgggggcctcagcattacagagtgattgagcaaccttttaattaccctctggtcaccacccctaccttcaaatgctatcccgacctgtctcactccctcttccttttttattccctttcccaaactcattcttcacagccaaacttgtcctcattcaacaaatatttattaagtgccttctgtgtcccagatatagctccagatgccgtggggagagcagcaccttaggccaaggttcctgatctcaagaagcttctttttttttttttttttgagacagggtcttactttgtcacccaagctggattgcagtggtaggaacatggctcactgcagcttcgacctcctggactcaagtgatccttctgttgcagccttccatgtgggaccacaggcccacgccatcatgcctggctgagtttttgattttttgtagaggggggtctcactttgttgcccaggctgatctcaaactactggcctcaagtgatcctcttgcctcagcctcccaaagtgctgggattacaggcgtgagccaccatgacctgccagaagcttctagtcttgtcggggcccggggaagccaggcaacacataaacaggcaaactcacacattttttttcaaacacatttttaaaagtgatggtgaaaggtaattaaaaatagactggtgcaatggcacatgactataatgccagcgctttgggaggcccaggtggtaggatcactggaggccaggagttcaagaccagcctgggcaacatggtgaaatccccatctctacaactctacacacacacatacacacacaattatccaggcatggtggggtatgcctgtagtcccagttacttgggagactgaggcaggaggactgctgaagcccagaggtcgcggctgcagtgagctatgattgcaccactgcactccagcctaagtgacagagcaagaccctgtctttttttttttttttttttagatggagtcttgctctgtcacccaagctgagtgcaatggcatgatcttggttcactgcaaactctgcctcccgagtagctgggattacaggcgtgcccggctaatttttgtatttttagtagagatgaggtttcacaatgttggccaggctggtctcgaactcctgacctcaggtgatctgcccgccttggcctgtcaaagtgctgggattacaggtgtgagccaccaggcccagcctacctgtctttaaaaaaaaaaaaaaaaaaaaaaaagagtgatgtgatacagtgactattttacattaagtgatccttaaaggtttctaggaggggagatgtctaatctgagttctggaggaacaaaaagttcagcttttcaaagttcagaagactatcctgggcagtggcgcaagtgaaaaagtagcaacaattatgtacggaaaagtagacaggtggcaggtcatgttgagcttttcaattcaggggatcaagtttagatattatcccaagtgaggctggaaaccatttgaatagtttaagtggagttgtggcaaatttttatgtgtactttaaaatgggggcccccaaccccagggccacatgccagcactggtctgtggcctgttaggaaccaggctgcacagcaggaggtgagtggcaggtgagggaagctgagctccacctctgtccaatcagtggcggcattagattctcataggagctcgggccctattgtgaatttcatatgtgagggagctaggttgcgtgctgcttgtgagaatctaatgcctggtgatctgtccctgtctcccatcacccccagatgggaccatctagttggaagaaaacaagctcaggactcccactgattatggtgagtatgtaataatacaactaaagtacataataaatgtaatgtgtttgaatcatgccgaaatcatcccgttgccccccatggaaaaattgtcttccatgaaaccagtccctggtgccaaaaagtttggggactgctggctgggtgcgatggctcacgcctgtaatcccagcacttttggaggctgaggcgggtggatcacctgaggtcaggagttcgagactagcctggccaacatggtgaaaccctgtctctactaaaaatacaaaaattagccgggtgtggtcatgggcacctgtaatcccagctactcgggaggctgaggcaggagaatcacttgaatctgtgaggcagaggttgcagtgagccaaggtcatgccactgcactccagcctgggtgacagagcaagactctgtctcaaaaaaggaaaacaaaaaacaaaacaaaacaaaaaaacatttaaaattaccaagctagcagatagactaaatgaaaggttgagcagggttaaaagtgaattgatgacctagaagattttattgacgtattctctcaggctatagcataaaataagaacagatggacactattacatggaaggtaagcatcatggacgtaatcctttaaaaggaataccagagaggatggagtagggagaagtaatgacataaagatcacagaatttcctagaacatattaagaatctcactgagtcctgagaagaataaaaataagcaaaaaaaactccacacctaaatagggggtagttaagaataaagagaaaatcctaaaagctgtcagagaaaatctggcagattacctaccaaagcatgagagtgagactgacatcagccacggggcctgtaagaagataatttagtggcgccatcaaagtgctgagaaaaatatctttgatcttagaattttattctcaatctcccagtcaatattaagagtaaaataaagacattttggatcttctaagagtaagacacattaggacctacaaactctctctgaaggaatgaataaaggacattctccaagaagagaaatgaaccttggaagatataatggattgcaagaaatcaatgtgtgcaaagaaattagcaggcttggtgtggtggctcacgcctgtaatctcggcactttgggaggccaaggtgggtggattgtttgagctcaggagttcaagaccagcctgggcaacttagactcgccatttctatgaaaaaaaaaaaaaaaaaaaggcatagggccaggtatggtggctcacgcctgtaatcccaacacattgggaggccaaggtgggtagatcacctgaggagttcgagaccagcctggccaacatggtgaaaccctgtctccactaaaaatacaaaaattagctaggcgtgttggcacatgcctgtaatcccagctacttgggaggctgaggcaagagaattgcttgaacccgggaggcggaagttgcagtgagccaagatcgcgccattgcactccagcctgggcgacaagagtgagactgtgtcaaaaaaaaaaaaaaaaagacattaggccgggtgtggtggctcacacctgcaatcccagcactttgggaggctgaggcaggtagatcacctgaggttagaagctcaagatcagccaggccaacatggtgaaatcacgtctctacaaaaatagaaaaattagccaggcgtgatggtggtgggcacctgtaatcccagctactcaggaggctgagtcaggagaatcgcttgaacccttgaggctgaggttgcagtgagctgagatcaggccactgcactccagcctgggcaacagagcaatactccagtgtcaaaaaaaaaaaaaaaaaaaaaggacattagcaaaagttatttgtctaagtaaatatggattgtgaattgttttgacattttaaaattataatctgtagctagaaggaaacagggacttagaacaaaagtagctctctcagagccaaagcttttaaccacttgtttttcggttttttgcttgtttgtttttgtttttttgagagcctcattctgttacccaggctggagtgcaatgatgcgatctcggctcactgcaacctccacctcacgggctcaagtcgatcctcccacctccacttcccaagcaaccagaactacaggtgtgtgccaccatgcccggcgacctttgtatttttagtagaggcttggtttcaccatgttgcccaggctggtctcgaactcctgagctcaagtgatctgcccacctcgggctcccaaagtgcttggattacaggcgtgagccgtggtgccagaccttaaccacttgttttgtagaactggttcctcagtgtctagcacagggcctagcacaaaccaagtgctttgcaaccacttgccgaaagaaggaatgaacggaccgatgaacggtgctatcagcatgcagcgtttccagaatattgccattttcacagaggagtgagatttgccacctctgtgagtccactgaggtccctgtagccatgagcggggacacgggcagccaggagtgctgtgctgcagactcttctagaaacaagtttggattgtgctccttccaagggcttctgggaaaaatgcctctctgctggcagctctgcccttccgcctaaggccaagaaccctctgaacaaatagcagcttagtgagagggcaggaggggacagccacatgtctggagagcatacacttcctgttcactgagtgccacgtgggacttttttctacttattccagagccggtctagattcttgagcaaacaaatagaccacccctgtgtgcaagcccacttctcgacctgtgggagaaaccccagtaatgagtgaaaagtctacgttgcaatatttcctgaccccgtttaattctgacactccaagcctgagctttcgcaaatacatagtgacttagaaactagaggatgctcttaaatgccatttattccagatgcagagacgcgtttcaatgcaaggcacaaaaaatgaagttactcagctttttctaatgttggggtgaaatatggccgcagggagggcaaactccactcattatttcccagggagaaatcatgatattttagaaagggtggggagaagtcttgaacaccacaactaatatctaacacaacaattgagtttccagaaaagttcaaaaccaagggcaagacaaataggagatgtgacttggcttggacacagactgccagtgtgaacggccatggcacctacctttcgggagagaactcccttttctaatctattgagaccattgagactccatctttaaggttctttctagtcctaaagttgtacaatttgccatattttggctgcaataatttcctagtctcctctggccatttctattcatttactcacttttaattaaatgagtgttacctgaattcacccttgtaggaattgtatatagttgcattgctacttttccaaccacattcctgcatcaaccagccaccagtgctctcaattcctgcacagccaccaaacagccaacaaatatttatcaagttcctcacatgagccaatcgatgttggacagtaaagaaagcaaacagaccctgcatccaaggaacttgtatttcactgggggaaaacaaactaaatgtgtaaacacatacatacgtagaataattccaggtattagtaaacactaggaagatgtggatggtgaaaacagccacggtgacgaaccagaggaaaaatcttctaagcatagcaatggcaaccacacaagtcccgagacaggaaacagcctggcacctctgaggaaggaggggactgcaaagtggctggggcacagtacatgagggagaaagtgtagggagaaggggtgagtgccctgatcatgcgggcctttgaattttattctgaggactttggtctaagtgtaatggtaccactgcatggtcttaaggcggggacttgatgtgagctgacatatttccgaaagatcactctgtctgctgtgtagaggggtgggctggagaacagggggactatgcagtcaccttaagaaaagttcttggctgcctgggctaatgttagcattggagagggtgagaagtgatttgggacacacagcatgcaaaggctgctgagggcagctgcagaaactcacggggttgctgtcattctccactaaattctcggtaatgctggcatgttttctcctgtcgttgctcaggacactctcagcacattctcccttaaagccttctaccctgcctcttccctcttccctccagacgttagcttgcagcttctgtagagtaaaaggatgccacccacctgcgggatcgcgctccacttcgtgccccacgcatacatgtctgggaaccccgattccatgttttcaggctccgaggaagtccctgggaggcttctctctaacccccaccccaggtccttctgctgacatcctctgagccgctgctcctccaacaggccttctcttccacacgcgccacttcctgaactctgttgattccttcaccgcgtcttaggaacttgcccaagtctctcccaaatccaaaaaccaactgccacttcctgcacgtcctgccctcccttcgttccctcctagctgtctccacgccgttgcctctcattcactccttggttggtcctcgctgcagccattcctctaaatcctcagctgcaaccttctaataaatggacacacatgacttttcctctcctcttctttcagctccccggcgaggtagccccctcgcccaaagaagggctgcgctcactttggggcccctgtgcacctctggcttgcctggagccagctggctgccactctcaagctctgcccacttcacctgcgccgctgttcccaggatcctgggctggcttcttgatattctcacttggtggggtttttgtgagtaatgttctctgggatcagggcttcagctaccaggtcaccaatgactcagaccccacctcaggtctacctaaatggctccctctcctctcctctagtctcctcctttttgcatggctaccgtttcattcaagccttcctgttttcttccctggactaccgtggtagccaccacgttgatcacactgtctacaatttttttttttttttgagatggagcctcattttgacgccaggctggagtgcagtggcacgatcttggctcactgcaacctcctcctcccgggttcaagtgattctcctgcctcagcctcctgagtagctgggactacaggtgtgcaccaccacgcccagctaatttttgtatttttagtagagacggggtttcactatgttgggcaggctggtctcgaactcctgaccttgtgatctgcccgcctcggcctcccaaagtgctgggattccaggtgtgagtcaccgtgcctgtttttttttttttttttttttttttttggacagagtttctctcttgtcgcccaggctggagtgcaatggcacacactcggctcacagcaacctccgcttcccgggttcaggcaattctcccgtctcagcctccccagtaggggattacaggcatgcgccaccatgccaagctaatttttgtatttttagtagagacagggtttcaccatgttggccaggctagtctcgaactcctgacctcaggtgattcacccgccttggcctcccaaaatgctgggattacaggcgtgagccacctcgcctggcctacagttgttaatccttccaattcatcctcttgaagccactagagtaatctttttaacagtgaaatgccatgccatttcactttttatatccttcagactgggtttagtagctcacgcctgtaatctcagcaccctgggaggctgaggcaggaggattgcttgagccaaggagtttgagaccaacctggcaacaaagtgagatcctgtctctaacaaaaaacaaaaagcaaacaaaaaaaaacttagccaggcttggtggctcacacgtgtggtcccagctactctggagactgagctgggaggatcccttgacccctggaggtcgaggctgcagtgagatgtgattgtgccactgcacaagagcctgggggacagagcaggaccctgtctcaacacgaaaccaaaaacatccttgaatgtctccttccgcacctttagagcagttgtttttcttttttgagtttgtttcactcttgtcacccaggctggagtgcaatggcacgctctcggttcactgcaacctctgcctcttcctaggttctgaagtttcttagc

SEQ ID NO: 1747 - DNA, 5919 bp, Homo sapiens
ccactgatgaaaaacctctactcctgtatggattttatattactggttgaatcgctgtttgttgtattattttgtattacatttaacatccatgaaaaacgtacatggctgcttatgggctgcggccactcaggcggcacacaaacctggcttgatgcagagggccttatgactcagggtgcctaaagctccagcagaactgctaactcagatgtgaaaatgccagtgtaatgtggttgcattacctgaagaaatcacttcagttatcctcatggtggcattttttttttttttttttttttttttgagacggagtctcgctctgtcgcccaggctggagtgcagtggcgggatctcggctcactgcaagctccgcctcccgggttcacgccattctcctgcctcagtctcccaagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcccatggtggcattttaactgaagctgctgaaagacaggagcttaaaatgagtttataaaagcaaagtacaacagttttggacatgtctggggagatgacttggctggggctgactgtgactactgggggtgcctttatctgaagtaattatataaataagattaaaagcaacccagagaggtactgatgataagtgattccctgggccctctcaaggcctaatgaaaaggttagggtgagaaaggtagtctggggagaagaattagtgatgcaatgtgatactgaataagaaaactgagttgttgttttactctttagaatttacttaaaatggatctacctgctgtctctacaatctccttagaatcacccaacataagctcaaatcttaacataagcccttcccaattccttcttaatgacacaccccatagtttctgtgccgtgttctctttcttgctgcagcaaactaaataaacctaacttgaaaaaatatataaaaatcaaatcaaatgggtctaaatagttattacaaaaggaatttaaaattatttattgtatttattcacaaatatggtgtctcagtccattttctgttgtttagaatagaatacctgaacttgagtaatttatttataaaaagaatttatttcttatagttatggaggttgagaagtccagggtggaggggtgcatctggtgagagccttcttgctggtggagaccctctgaagagtcctgaggcagtggagggcatttcatggtgagggggctgagcatgctaatatgctaactcagccctttcttcctcttcttataaagttaccagttctcctatgatcaccaattaacccattaatccatgaatgagttaatccatttatgagggcaggggtgataattcaattacctctcaaaggcctcacttctcaatactgccacacttgggattaagtttcaacacaagttttggaggagacaaatattcaaaccatagcatatggcatactcatttattattactagtttaagtggaaatcattttataaatggtaaggattctgtctcaaattcatttttgatagtttatattccaaagtgacctcaatgattagtcattactatcaaaatcctggcatcaattagtactttacagtactgagaccaagatcatctcccagaagctttcataagacatgactcagtaccacagaaatcatgttgtggccttaagaaatggttctattattctatcaagtgattctggttctctctgccttgtactgcaagatcctggacctgttgcattctgtttcaaatttctacgaatcttaaaaaaaaatgtaggaaaggcctccatgaggacattcacaggtaggatgtggttcttgccacacctggctttgaggttgatcacttctgtagtcaccaccacaccaagctgctgaggctgggatggtctccctccctttcctgacggaaaatactttttcgtgaaaagactttcacttttctaagtataccaagacaatttctagactggaggtattacgtgtcccagtataagccttcagagagccagtacttgccaagttagggtgaacaatgttttctaaatctctttctaaattactgtatttcctttgtgtagtttcttataaaaattcccttggaaaaactctaaccttgcttagctatcagccactcctgaactatggaagcagtgctggagagaaggaaggagatgctcccaagtaggatttccctcttaatctctggctcctattttatccaggatgatcatctagaaggagggtctctgctcaaatgtcgcttcatcagagaggcctttctaccactctatataataagatcctatccccaccattctgtttaaagtagcatggcccttttatcaaatgaaattttacattgagttccaatatataaaacagacgaaaacacagctactctgtctgaagcaggagcagtcacagcctacaaggcctctaactcagccttatttctacttctcaccttccctctagcccccttattctgttttgtttttattttttccccatagcacttatttgtttagtatctgcaatggaagaatagattgctacacagctattctggagcacttatagaaagcaatgcaaagagcagttgaggccagttgaagatgtgagggagtagagaagtgtattcaaagcacgtatgagagcaaagtcaccttagcagcaatataggcgattctgctacgagatcccaccagtaactgagcagttatataggaaatgatgatgaggatcagtggtctctgggctgtgtaccttggggtcccacagaaaggcctcaagggctgcctgaagataaaagggctactttaaaaaggcatgaaaaccctgatgcagatgtcagggatttaaagtctgaagattttataagaatctctgaaaaagaagcaagaacaaaatactgaagatcttcatttagtaggacaaataacagaagttcccacagtaaggaggagatgagagggggagatttgaggcctcttgcataaatcagctgagatgtgtgtggtgagcagagggcccccacaccttccaacatgaactgaatcctgccccctcaccatgtggtcttaaggactgaagctcccatgatgctccctggagctgcttcttcacgggcatgagctggctacttggcaattcctcagtgatttctgaaggtgctagcttctctgcaatcatgtccttccttcgtccaaaaaagatctaaaaacaggaataattgaggctgaagaacaccatcaggttgggacttgaggataaaataacagagaagaaactatgcaaaaagtatcatggacacaggaaaagggagggaaaaagtagagccaccttctatttgctgggacacccattagtactttcacccctatacatccagttgtgctgagtgggaatacagtttgagagctctactcccaatgatgtgccagtgctcttgactcagcctgggggttcatctccacaggcatccttcttacctgctttggtccatcaagctctctctccacatcctccagcatagtcacagtttcctctccattctctggatgatgcttctgcacccaggcctgaagctcttttgggaggatggccaggaactgctccagcaccagcagctccaggatctgctccttggtgtgcacttccggcctcagccagagatgacaaagttcccagagccggctcagagcctcatggggcccaggtgaatcctggtagccaaactgcctgaattgctggcggaaggtctctgggctgtagctgctgctccagtggaggctagagtctggatcacaggtctgctcttcctcttccatcttctctgtcagaatcccattacactcctctgaagtttgtgttaggagtgatgatgactttcccaattttgcagacattttgacagacaaatagctcagtactgttaggctttaatcctcaaggaggtgaagctgtcctgatggacactccttaaatatgattaaagaaacaagtggaaagaagacaaaagacaaatgcttcttagaacaaaacaactaagattagaaacataagactgtataggaactactgaccttagtcttaacagaaaccatgcttttatttatttatttatttttgagatggagtcttgctctgttgcccaggctggagtgcaatggtgtgatctcggctcactgcaacctctgcctcctgggttcaagtgattctcatgcttcagcgtcctaagtagctgggactacaggtacccgccaccacgcctggctaatttttgtattttcagtagagacagggtttcaccacgttggccaggctagtctcgaactcctgacctcaggtgatccacccgccttggcctcctgaggtgctgggattacaggcttgagccaccacgccaggcccagaaaccatgcttttgaagaatacttctttaagagaaccaaacagctaagactcattaattcatatgcataagtgattcacaattcattctgaaaaccatgcccacaaggctactgaatattacaataagagatcagccaggattgcatagaagctcccagataatggaaataagggaagcctgagaaatgctctaactctggagccagttcaaagagccaatcggtatttagtgtgctgcaaagagctcaaagaaatagtctcatgagggaagcacttttgtgtgacttttttcagcttttactgttaaaacattacttcgacattaaaggaaccattaaaaaaaaaataaaccaatcagctgggcactgtgcttatgcctgaaatcccagcactttgggaagccgaggtgggagatgggaggatcacctgagcccaggagtttgggaccagcctgtgcaacataatgggaccccatctctaccccaccaaaaaaaaaaaaaaaagaaaaaacaacaaaaaaggcaatcacgttccttcatctgaatgtatttctatttttttccatatccatattacttacttaactattttaaaatacttaggttgtttctaatttcactattataattaatgctgggaggcacatctttatgaatatactgtttttctcctttcaaagtatttctttcaagcatgtcccaaggcctctgcttgttgaggatcaaaggagaagagcaaattctgtcttgctatgtattatcaaaatattgcacaaagactgtatcaattcacaataccatcacaatcatagtgacttgtgagggcaacgatttcttcaagtattattagctcgttagcaacaaagttggggggggacggcactttcctttgtatcattttactgttaagtatcaccagtaactaatctcattttgttgttgttgttgttttgttttgtttgagacagagtctggccctgttgcccaggctggagtacaatggcgggatcttggctcactgcaacctctgccttctgggttcaagcgattctcctgcctcagcctcccaagtagctgggattgcagacgtgtaccaccacgcccggctaatttttataattttagtagagacggggtttcaccatgttggccaggctggtctcgaactcctgacctcaggtgatccctctgcctcggcctcccaaaatgctgggagtacaggcgtgaggctctgcacccggtctaatcatattttttaaattgggcaggaggtatatgatagtgtttgtacaacttcagcaaatgatgactactttaaaaatcttacgtgcgcctccgtcttcc

SEQ ID NO: 1748 - DNA, 1884 bp, Homo sapiens
agaacgggagtgcattctcaggcacctaaatcttacaggctcagtgcctgcacagggagacgggtccgcagcccagggtcccgggcagctttcgggcttgggggtggattgacacacagcccgatggtattcacacccattccttcactgtcgcgcccggtcctgggggacggcatggcaccagccaacgtcacgggttgggtgtgagttcatggtagattctcacacgccagcctcacaagaggcactgccgagaccaggcttgctgccgcctactgtatggccggccctgtgggcacagctgtcctccacccgcctcccaaggcaccatcgggcccagaatgtgcccgatgagtcacgggcctgggtctccccagcatgggcgcagcaggggggctgagtccgcctgagccccggtgcccagctcagggtctggcacagagcagatgctagtgaatgaacgtcgggctggatgaatgaacgaatgactaatgcccgctccctcaaaccacaggctacaccgtctgagcctgggggagggcagagcccacgggaccccagaagaggcctccgcagctgaggctttgcgtcccagggtcgatgggggagggggcggggcggccagcagccggcgcggcacggggctcccctccttcccgagaaggaatctgggtctctggactgagctggtgacgggggctggggcggggggttgtggcgtcctggatggagagagctgcaggagcagggggcgcgtcccggtttgcgttggggtgtgggacgaagcggcggccgcgggacatccccttcggtggcgaagcccgggtctgcccggggcctccgcggggtgcagagggctcccaacggcgggactggcccggggcgccgcagacctggccctttccggcggggccgtggagaaggggacgcggtgtcccccgaggtgaccgggggcgcaggaaggacggggggcgcgcggagccccctctccacgcgcgggaggtccagccccgctaccgccccctacgccctcccgggacctccgcccacctgcgcgaggggttcacctgggccggcggcccctcctctagacgcgcgagtccctcccccgggccccggccctgccctccccgcgcccgccctcacctgcacggcccgccttggccatgtcccgggcggcgggctccggcggcgctacgcgcgctcctcgcgcttcccgggcccggccccgaccgcctccggccccgaacggactccgagcgccgcgcccgcgcccccgccccgctcgcctcggctgccgccaccgcagccgccgccgcctcgccgctccctcccgctcccttaaaggcgccgagcggcggccgcgccccccccccaccccaccccccgcgccgccggggagggactgacgaaggaaggcgcccaacgccgcccccgcgggcccgcacccccgccccgggccgtggccgccgcgctccagcccgctccgctccggcccgcgcggccaccgcagcgcgcgaggggcggcagcccaggggctcagagacgcggagacagcccgagacactgcgggccagagacggggccctggactgggagaggggcgcacagactattagacagcgctggagagagacgctcctagggccagaacgccgaggtggagggagagagagagaaattcagaggagaccagagacccagagcccggctccggctccgggagagacggacagagggagcggagagaggaaggaggacagggatccaagggaggcccccacgaagtcaagaggaaagtcgctctgggatcagagacaagagagggaccccctccatcagcccccgctccaggggttctggatcatttatggcgtctgacct

SEQ ID NO: 1749 - DNA, 4456 bp, Homo sapiens
tgaatctggtttctcctctttaaccatctaaacttttactattgctttaggactgcctctcctcatttattgctatgttgattgcactgccctgccaaaccatattggagctggatcaggggaaaataagcatatatatatatatatatatatatatatatatatatatatatatgcatgaaaatatcctcccatattgtggaccaagtggaaaagttaatgaagctctacaatgaaaaaaaaagttgactatgagtaaagtctcatgttgtccaatctgtaatcctattattgtcaaccctcgtaagcccgcccagtggatgaggtggtgggagatgacgagggtgggatgggcattctgcagccagtggggaagaaggcagggccctaaaacaaacaagaacaagcatatctttatttagaatttggatgtattttcatcgtgaatttcctttgcattcattttgattaaaaaaaaatgcattatggctgggcgtggtggctcacgcctgtaatcccagcatattgggaggctgaggcaagtggatcacttgagcccaggagtttgagaccagcctggccaacgtggcaaaaccctgtctctaccaaaaatacaaaaatatatatatatattagctaggcatggtggtgtgcacctgtagtcccagctactttggaggatgaggcaggagaattgcttgaaccaggagacgaagggttgcagtgagctgggattgcatcactgcactacagcctgggcaacagagcaagactctgtcccagaaaaactaaaaaaaatgcattaaaataatatttatctgtattgctgaggtttgaggcaccctcttaaattttacacctaggcaatacctccagctctcacactaatccaggctctggtctattacaaaagtccccgcgggctctgacctacacagctgccagttaccttcctaacagacgaccagtgatcatgtcactttcttgttaatccagactgctgggagcgaaaattcagccccctcggtttggcgttgaagcccctttacaatctggcccccacctaacccaccagggcgcctgccctgtctggccctgttcccacctctcttgcctcatcaaacttctgccagactgcacctttgtccatgctctgctgtctgcctgaattgtgcccctgtctcctgaattgtgtctccaagccccttcacctaaaatattcctgttagctctcaagtttcacctcagatatccctgactggctgggcagacttcttagactctcgcaagcaggcttctttgttctgttttcccataggaaattgttcgtttccactcaattcatatcttggtggttgcattcatttttcgactgtgatttatctgtttaccggtgtccctagttccactgccagctccttgaggcgagcaaccggggcttttcatgtctaatgaataaatgaatacaatttgacacagtgaaaaaggcaggaacagcaaccataaaaaatccatgaaaaacaaaagcacagaggacaataggcagagaggacactggtcttttttttttttttttttgagggggaattctcactcttttgaccaggctggagtgaagtggtgtgatcttggctcactgcaacctctgcccccagggttcaagcgattctcctgcctcagcctcctgagtagttggaattacaggcgtctgccaccacgcctggctaatttttgtatttctagtagagacggggttttgccatgttggccaggctggtctcgaactcctgacctcaggtgatctgcctgcctcagcctcccaaagtgctgggattacaggcgtgagtcactgcgcccggccgacactggtcttaaaatcaggagaacctggatttggcttttggtcttgtcattagccagctttacaactctgtcattattttcagattttttactatggaaactttaaaattgtagcaaaaatagaacagcctgatgaacccacatgtacccatcatccaactagaacaatgtgggttcatcaggtttcttgtcatactgccccgctctgctacccccatccctggattgtttggaagcaaatcctagaccttactgtcacttcacatataattattaaaggaagaacatgaacattgtaattgattgcaaactcaccatgaacctggtggaaagaagagatcacaataggccgagatcacggggaagctcttggaagcaagttatgaaggaggaatacggattttggcagagaaagtctgtaagtaggaagctgtaaatcatgtgtccaacatgtggtgagcagattgttttatctggagtggggactgggtggcggaggggggtgagcagaggaaaatctaggcctgggacagagaggcagcctttgggcaatgggacagactggagactcttttagttttatgtaatgcaagggctaaggaaaaaactttgcctttgtcccctgaaggtttgctgaaaaatcaactgacaaaaagcagattaatagaagagaaggctggccaggcgcggtggcccacgcctgtaatcccagcactttgggaagttgaggcaggaggatcgcccaaggtcaggagttcgagatcagcctggccaacatggtgaaaccctgtctctactaaaaatacaaaaattagccgagcgtggtggcatgtgcctgtaatcccagctactcgggaggctgaggcaggagaatctcttgaacccaggaggcggaggttgcagtgagccaagatcgcaccactgcactccagcctgggcgacagagcgagactcggtctcaaaaaaaaagaaggcaaggtatataagtgtattagtgtgcgctgtgggaggagggaggaacacagagtgattacccatatcctagtggggtacagatgtttatatgtcttgttttttttaggggaaaaggagatggggaagtgtggatgattttagggaggtaacagatgatttttaggggaattcaatgagcttgaagaacatacaatggcttgggacaaagtctgtttgggcagacaatggtttgtgacaaaaatctttccaggtgtgttgaccgacttcagtgttttgccctgtgatatgggttcagttaatgaaaactcagggagggaatggatcagaggtgattgttttcttttttgccaggtctagacgttaggcagataagggaactccagagaataacttttattctgtgttttgggaggacagaaatgatgggaaagggaggaagatcagagatacattgaggcttcttcctcaattcagcatgtcaaagcgccatattttgggataccgctttctgagccccaacagtaactaggtattattttgaagggttgcattcacacttgtgacatggagtaaaggccagtggtaatatttctgtagagcgctttagttctgtctctcaatgtactttccttgttaactaatttctcctttagtagcaaaaggaattgtgacaggtgcatttaaagaaactgttacctgcaccaactaccaggcattcgttagttggggagaaatgagaactcatgttttccatactcagccctaccccaagatgacctggcaactgtacattttatcccactgggtttaatccttattatgaataacagagcgaaactttgttattcatgggagtggatttctcctgctgagagaattagcggcaatctcattcaggaagctgccttctgatgcaatgaggtcttttgaactgtgcataaatagaggccattctttaggcatttggagcatagggcttaaattgctccagaagttccaatcagactctaggtatctttggctgttttttttgtattttttttggttttttttgagacagaatctcactctgtcgcccaggctggagtgcagtggcacaatctcggctcactgcaacctctgcctcccgggttcaggcaattctcctgcctcagcctcccaagtagctgggattacaggcgtgcgccaccatgcccagctaatttttgtatttttggtacagacggggtttcaccatgttggccaggatggtctcgatctcttgacttcatgatccacccgcctcggcctcccaaagtgctaggattacaggcgtgagccaccacacccagccttctttgactgattcttctctgtgtgcgcatgtcctgaggtcacaagtggtagtgtgctccgtattggtttcttgacctgcctcttcaggactttctaaaattaaggtacaaccgattcttttgctgcagtcctttctgcctaaagaaggaagaaattcttctgttttcagaaaaaaaaaaaggaaaataaaagaatatgccagcttcaccaggataacccacagacattgagcattaggagtatggtacaaaaataatttctttcctcattaaggttttttttt

SEQ ID NO: 1750 - DNA, 7958 bp, Homo sapiens
ataggaaattgttcgtttccactcaattcatatcttggtggttgcattcatttttcgactgtgatttatctgtttaccggtgtccctagttccactgccagctccttgaggcgagcaaccggggcttttcatgtctaatgaataaatgaatacaatttgacacagtgaaaaaggcaggaacagcaaccataaaaaatccatgaaaaacaaaagcacagaggacaataggcagagaggacactggtcttttttttttttttttttgagggggaattctcactcttttgaccaggctggagtgaagtggtgtgatcttggctcactgcaacctctgcccccagggttcaagcgattctcctgcctcagcctcctgagtagttggaattacaggcgtctgccaccacgcctggctaatttttgtatttctagtagagacggggttttgccatgttggccaggctggtctcgaactcctgacctcaggtgatctgcctgcctcagcctcccaaagtgctgggattacaggcgtgagtcactgcgcccggccgacactggtcttaaaatcaggagaacctggatttggcttttggtcttgtcattagccagctttacaactctgtcattattttcagattttttactatggaaactttaaaattgtagcaaaaatagaacagcctgatgaacccacatgtacccatcatccaactagaacaatgtgggttcatcaggtttcttgtcatactgccccgctctgctacccccatccctggattgtttggaagcaaatcctagaccttactgtcacttcacatataattattaaaggaagaacatgaacattgtaattgattgcaaactcaccatgaacctggtggaaagaagagatcacaataggccgagatcacggggaagctcttggaagcaagttatgaaggaggaatacggattttggcagagaaagtctgtaagtaggaagctgtaaatcatgtgtccaacatgtggtgagcagattgttttatctggagtggggactgggtggcggaggggggtgagcagaggaaaatctaggcctgggacagagaggcagcctttgggcaatgggacagactggagactcttttagttttatgtaatgcaagggctaaggaaaaaactttgcctttgtcccctgaaggtttgctgaaaaatcaactgacaaaaagcagattaatagaagagaaggctggccaggcgcggtggcccacgcctgtaatcccagcactttgggaagttgaggcaggaggatcgcccaaggtcaggagttcgagatcagcctggccaacatggtgaaaccctgtctctactaaaaatacaaaaattagccgagcgtggtggcatgtgcctgtaatcccagctactcgggaggctgaggcaggagaatctcttgaacccaggaggcggaggttgcagtgagccaagatcgcaccactgcactccagcctgggcgacagagcgagactcggtctcaaaaaaaaagaaggcaaggtatataagtgtattagtgtgcgctgtgggaggagggaggaacacagagtgattacccatatcctagtggggtacagatgtttatatgtcttgttttttttaggggaaaaggagatggggaagtgtggatgattttagggaggtaacagatgatttttaggggaattcaatgagcttgaagaacatacaatggcttgggacaaagtctgtttgggcagacaatggtttgtgacaaaaatctttccaggtgtgttgaccgacttcagtgttttgccctgtgatatgggttcagttaatgaaaactcagggagggaatggatcagaggtgattgttttcttttttgccaggtctagacgttaggcagataagggaactccagagaataacttttattctgtgttttgggaggacagaaatgatgggaaagggaggaagatcagagatacattgaggcttcttcctcaattcagcatgtcaaagcgccatattttgggataccgctttctgagccccaacagtaactaggtattattttgaagggttgcattcacacttgtgacatggagtaaaggccagtggtaatatttctgtagagcgctttagttctgtctctcaatgtactttccttgttaactaatttctcctttagtagcaaaaggaattgtgacaggtgcatttaaagaaactgttacctgcaccaactaccaggcattcgttagttggggagaaatgagaactcatgttttccatactcagccctaccccaagatgacctggcaactgtacattttatcccactgggtttaatccttattatgaataacagagcgaaactttgttattcatgggagtggatttctcctgctgagagaattagcggcaatctcattcaggaagctgccttctgatgcaatgaggtcttttgaactgtgcataaatagaggccattctttaggcatttggagcatagggcttaaattgctccagaagttccaatcagactctaggtatctttggctgttttttttgtattttttttggttttttttgagacagaatctcactctgtcgcccaggctggagtgcagtggcacaatctcggctcactgcaacctctgcctcccgggttcaggcaattctcctgcctcagcctcccaagtagctgggattacaggcgtgcgccaccatgcccagctaatttttgtatttttggtacagacggggtttcaccatgttggccaggatggtctcgatctcttgacttcatgatccacccgcctcggcctcccaaagtgctaggattacaggcgtgagccaccacacccagccttctttgactgattcttctctgtgtgcgcatgtcctgaggtcacaagtggtagtgtgctccgtattggtttcttgacctgcctcttcaggactttctaaaattaaggtacaaccgattcttttgctgcagtcctttctgcctaaagaaggaagaaattcttctgttttcagaaaaaaaaaaaggaaaataaaagaatatgccagcttcaccaggataacccacagacattgagcattaggagtatggtacaaaaataatttctttcctcattaaggtttttttttttttaatttatgctacgagaaatagaacagagtgagcctattgttgtcttgccatcccagaatctcttaggaggacaaagagagatactttagtgtttgtaaagggagggttgactatttgtgcaggtttcaaaactcctgcaccccaagtccccagcagaataagcctctctgggtccattgaatggtgggtttttgaatggtggatctggggccttgtatggcagatgcacctgacagccataaccgaagcacatcctaagaatgaccctaaggttggccaggcgtggtggctcacgcctgtaatcccagcactttgggaggccgaggtgggtggattacttgaggtcaggactttgagaccagcttgggcaacatggtgaaaccccatctctactaaaaatacaaaaattagccaagtatggtggcgggcacctgtaatcgcagctactggggaggctgaggcaggagaatcgcttgaacccaggaggtggaggttgcagtaagccaagattgtgccactgcactccagcctgggccatagagtgagactctgtctcaaaaaaaaaaaaaaaaaaaaaaaaaaagaatgaccctaggatctaagaagaatgtgtgtttggacttccaagctaaggaatcggagagtggccaacctggagattcactccttatctatgacagacatccgaacccctagctcgttccttggaatgcaggccacctaggggatggaggccctttgctttgggttaaatggaggttgctaggtgggagggtgctaagtgaaaaacacaatataaactgcatgcttagtacaaacagcagtggttctcctgtccagcctgctgcccctggaatgccccttatgtaagtcctcaataaaccctgtctccctcactagctccgggtctctctctcttttttaatggagtctcccaggctggagtgcagtggtacaattatagctgactacaggcatgtaccaccacgcccagataattttaaaatttttttgtagaggcaggggtctcaccatcttgcccaggctgttctcaaactcctgggcccaagtgatcctcccacctcagactcccaaagtgctgggatttcaggcctgagccaccacgcccatcctgggtctcttttttggtgcctcggacatggtgccatccctgcttggagtcagcagaggtcttacgcgacagtccttggaatggtggaagcctgttttgttgtctttgatactatgaagggacaaacccctgctttgaaggtgtttatttcctgaaatttttacctgggatcccagctatctctttctttctttctttctctctctgtctctgggatcccagctatctctttctttctttctttctctctctgtctctctctttctttctccttccttccttccttctttctttctttcagatggggtcttgctctgtcgcccaggctggagtgcagtggtgcgatctcagcttactgcaacctccacctcccaggttccagcgattctcctgcttcagcctccggagtagctgggattaaaggcgcacaccaccacaccaggctaatgttggtatttttagtagagacaggggtttctccatgctggtcaggctggtgtcgaacttctgacctcaggtgatccgcccgccttggcctcccaaagtgctgggattacaggcatgagccactgcgcccggctgcatgacttttctataaagccttattttaaatgattttgggggcttaatttaggtgttttcatttgcttttggtcacagtctttatgtgtcactgagtgtgtggatgtgggggttcttctacccagaggaaagtgatttgatcacctggaaccaggtgctctgagaactggggcagcttccctgacttgcaggagagggtgcagagacttcttcgctggcatgtagctgcagcctagaaaaccgcttggtggtcctcgttcatgaacctgccgttgggggtgcttcatgctttatcttggtctctaccttgattaatctcacctccgtttctccgctccactggaccattctctagaacccctctagaaccactggaccattctcttctgtcagagtccagtgcttccagtctttcctgtgggctcttatcttctggtgcaaagttctttctcaccttccacagtcaaaatcaccatacttacctaggccatacttactaggctggagaggcaggtacatcaatctttcttgtttatttgtttgtttgtttgagatggggtcttgctctgtcacccaggctggagtgcagtggcacgatctcctccgcctcccgggttcaagtggttctcctgcctcagcctccccagtagctgggataacagttgcatgcaaccatgcctggctaatttttgtatttttaatagagacggggttttgccatgttggccgaactgctctcgaactcctgacctcaggcaatcctcccgcctcggcctcccaaaatgctgggattataggcatgagccagcatgctcagccaggtacattgatcttctaagtatttattgttctgctccttattcagtgctaacatttttattttcttattctttttccctgtcacttgaagatcgtcacccaagcaataaatccatttggttgtacttatttaattttctctgactttctaaggagtgacacagcaaagtgccttatcttgcatttctttccttttccgtgttctagttggaaaggctcagagtttgggagaagttaaacgtgactcagagaattgcttttgatggtggtgccgatacacacatcttttgaagcttagattgggtattgtcaatttaatttggagtctatcagcctgtagtgttctaatcacctattttgaagccttgctgacgacccgagattccttgttaaactgccactggaataagcataacacttttcattaaaggaaaaagaaaatgttacttaaagtaataggcacacccttttattttcttgacagatagcaaagaaaaaaatcttctgtctttaccttgacaagacatgtaccattgctgggaggttttgcttgtatgagaacttcaacgttagaatctagacatctcggagaattgaaactcaacaagtttctctgttttggggtggagaaaaaggacaaaaagttgtcatatacagctagctgtccaaacagtcaaatacgaaagctaatttatcttttaaaaggttaattctttgatgcctctatcacagttagtgttaaaatgaaagcattggaaacaaactctttttctgttagctcagattttaaaaaaattctttttgcagagatgggggtctcactatgttgctcaggctggtcttgaactcttggcctcaagcgatccttctgccttggcctcccaaaatgttggaattacaggggtgagccactgagccagattttgaatattttaattacttaactgcttgtctgtctggcaatgagataagcgcagtagccagtgattaccaacagttaaacagaagaacaagtcacataaacaacacttatacttcctgtaaacccaattaaaaccacatttcaggtttgctcttatgatttagaagtaaatttagaatcagtttcatgaatcttgcagtatttttcaaattaatgtctttaggcatttggacaatgggctgtgtgaatgcaaactgcgttttcttcaattgctatcaattagagacagttaagaactcaactgatgaagaaatagccacctgaaagtgagcccacaggcaagtcacaggcccctcttcctcctgaaggtgcacgggagacttcgttaaaaaaaaaaaagctgtagtaaaatacgtataagataaaaatttaccattttaagtttcttttttttgaagacgaagccttgctctgtcacccaggctggagtgcagtggtgtgatcacaattcactgcagcctcaccctctccggctcaagcgatcctcccacctcagcctctcgagtagctgggactacaggcgcacaccaccgtgcccactaatttgttgtagttttagtagagacgagattttcgctgtgttgcccaggctggtctcaaattcctgggctcaagtgatccacccgcatcagactcccagagtgctgggaaggtgtgagccaccatgctcggcccattttaagcattgtaaattgtacaatttagtggcattaagtattttcacaatgctgggcaaccatcatcactgttcactttcagaactttttcatcattccaaatagaaattccacccattaaacactaactccccaatgtccccttcccccaccctctggtaacctttatcctatgttctgcctctatgaattggcctattctaggtacctcataaaagtagaatcaatattatgtgttcttctgtatctggcgtctttttcttagcatgttttcaaggttcagctgtagcccatatcagaatctaatttcttttcctttttttgagacagagtttcactcttgtcactcaggctggagtgcagtggcacgatcttggctcactgcaacttccgcctcctgggttcaagcaattctcctgcctcagcctcctgagtagctgggactacacgcgcgcgccatcacacccagctaatatttgtatttttagtagagacggggttttgccatgttgaccaggctggtctcgatctcctgacctcaggtgatccacccaccttggcctcccagactgctaagattacaggtgtgagccaccgtgcctggctaaaaattctttttt

SEQ ID NO: 1751 - DNA, 112750 bp, Homo sapiens
ctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctggtaagttttttcaattatgtactagatgcagataaagtctgactttttccatcctagttaggggcatggttaatttcatatgtccccaggccttatcaagttgtaaagtaggcagtatacaaccttgaaacatttagcaaacctggtatctaacttatatgatttaaacctcctatttacgtgttgatgatatttgcattttccaatttgatctttaaaacaatttttatttcttagagatgaaagtcacataaactaaaaggcattgcagttttaactttcctctaaaatgtttgatttaagtgcatatttttatttcaggcaatcagttatagctcgttacagacatcacacacaacacatatatcattacacagacaaacagaagcagatccagtagttctaagatttcttcctgtcccacttcctaattgaattattggcttcccagtagagccctttaagagcagggatagaaaaaccatgaagtttctagggcctaatcaacttgtatagctgtaagacaaaagcagattttgagtgggatctatcagcctctaaattctgggattccatcaggaaaacagaggtttctcccaaaatggaatccactgtgccttttctgtttttcccaaaaagtttcaggccaccagacattaccttgggtgcatcaagagtggaaagacagagcggaggacagtaattcagccaacagaaaaattcttttcaagaaaaacacaatccaagaagagaaaaacatacgggccttttaaatatacctataacttgaatatccacttttaatcaagctgagcactctttcagaaattcctttgaaatcttctgttacctgactttagctaaatcaagcaggtaatatttctggcttttgaactttactaaaagtaacatcacaggtgaaaacaacaactctcaatcaggttataagttaactgtgagtattcaagatattttataagtggtggtaagcagcttttactagatctagaaactttaaaggcaatttagagaaaggaagatttcagaaaggaaattagagttgttcatggaggaggaagagatgattaaaggtcatacagctattaaattgaaagtattcatcacccaagctaggattgaacctgggccaccattgtaaaatggcaatggctaaaaaagtcctgccacaaggttacaggttatgctcaagacataaaacaagatagaggcatgcagcaaagtttgttacttaccagtttatgtgggtgacttgaatagtgagcttatggagtcccaggcctggattccattccaacgtattccaacccgttccaagatgggttgttacccatgcagaaaacggggggaatataaggtgtcccttagtctcctttctccttttgaagtgacccaggatgaagcaaaagattacaggggtgtccctgttctcctctttcctcccatctcctttgggtcccggtaaccatcataggtgctgtccatggatgaaagcatgaattgcacccatggatgtggaggtgctagctggcaggagtagtcatttttaccagcacaatgcctcctcacactgctcttctgggttcctaggcctcccaggagattctacagtagataaagttgggtgagacactttaatagagggagtgttttaaccctattcctgcctcctctagttatggacctggaaaagcagtgcattcccagaaaattttatccattgacatttaaatataaaatcccctttctgtttaaatgccaatgtggttggaagcagaacaggtgtctcaaaagaacatatagatttaatggctgtcctccttctgatggaaacagcactaaggctagaatttgtctctcaagggtggcttcctcccaactgttgaatgcggagtttttttccttagaaatggggcatagggtctgcttgctgttagaggaacacaaaagagggagaaatctgggcattagaattttttggcgaacggccaccaagaatttttacggagaaaaatagcctatctcatgaggtggtgctgtagggtctgaaaagttatgtaaaatctgtgactctaaattttttccaggaagaagttagaaagagaggtttggggtttaacaggctgtcactgtatatgcctcccagcagtagaaaattaacttgtctcattaataaactgttcaaattcattcagcagtgctgagcttttacatgaaggaaaagcaactgaaatggagagggatgagggtattcacttggggtgaaatatcttctcatagagtgccatgaatgactgctattgcgggacaagaagcacttactaggtgaaggtttagactgaaatcttgaaatcccctggtattttgtgtgtctgattacctttccaaaggaataaaatcagatatgtatccatctcagtgagcagaggggtgactttgagtagaatgggaggaaggtttgttctaagtagtttcccgcttgcattttccccagtgatttcaggggcccagtatattttcctttcacacatctgacaagggattaataaccagaatatctacggagctcaaacaactctagagggaaaaaaaatctaataattgcatcaaaaagtgagcaaaagatttgaatagacatttctcaaaagcagacagacatatggtaaacaagcatatgaaaatgtgctcaacatcattgatcagagaaatacaaataaaaactacaatgagatattatctcaccccagttaaaatggcttttatttaaaaaacagacaataacaaatgctggtgaggaggtggagaaaagggaaccatcatacactttttgtggttatgtaaattagtacagctgctatggaaaacaatttggaggttcatcaaaaaactaaaaatagagctatgatgtgatccaggaatcccacagctaggtatatacccaaaagtaagaaaatcagtatattgaaatgataactgcactcccatgtttattccagccctgttcacaatagctaagacttggaaactacctaaatgtccatcaacatatgaatggataaagaagatgtggtacatatatacaatagagtactattcagccatggaaaaatgagatcctgtcatttgcaacaacatagatggaactgaactgtacattattatgtgacgtaaaataaaccggcccagaaagacaaacatcacatgttctcacttatttgtgggagcagcaattccaaacaatggaactcacggtcatagagagtagaaagatggttactagaggctgagaagggtggatgggaagcaagtgtgaatgttcaatgagtacaaaaaacagaagaatgaataagacctaatatttgacagcacaacagggtgactatcgtcaataacaacttaattgtacaatttaaaataactaaaagaatataattagattgtttgtaacataaaggtaaatgctcgtggtgatggataacccatttaccctgatgctattactacacattatctgcctgtatcaaaatatgacatatgccctataagtatatacacctcctaggtaccaacaacaattaaaaatttaaaaaagtgtatccttcccagtgaaccgaaatattttacattgatcatttttacattatcatagtgtgttggaataatcatagctttggaaagaaaaaaaataaatgtaaactttcaaagatggcaggagatatagatctctctttctttagtggatttaaatatgcaatttgttatcaacattgcactgacaatttttaacacaggccatattctggaaatgatatgattataggagttataggaaaaagcattttttcatactgtgattatctaggctatgaggaaaagagatatttcctctatgatgtctaatttagcataattattctttttaaactatatttagatttaattaagagatacacaaacaaattacttttagtagtaagaagagtttttaaaatgttttgtgtaagatgactatgtagtaaagaaggttacaaacctgctttttaacttagaaaaataatctcaccttcttgccccatggaaaattgaaatgttatgtggaacccaatgtacaaaaactctcagtgaggatttctgtcttaagtttcaacggattgaggtgagatcagtgcctgttccacctttttcctccctgtcctaggtgacttgataacatttatacagccataaaattttgcttttaaattcaagtatagaaaataaactttaaaatgtgatatttttatatattttaccttaataatttatatgggaaatatttttgaaaggttaaaaaattaaaatttttaaaagagtatagtgaaataatctaatcacatgtggaaattgtgttactatttccccaagcattttttgtacatgtaattgaaaatgagttgaatgtaactcataagtagtataaaagtgtttaatatttaattttctgctgcagtaatgtgacataacaaccttaaattcttggtactttaaacaagatattttttttctcccaaatttctaggttatttaagggcagttctgcttcatattgcagtttgcctgggctttactccaggctgtgtgttggagttaggtctaatctattgtatccctacacatcccacttagaaaagctaacaaatttcctttggacttcagtcagttcgattgtatttgtcattcaaaagccaaatcatttatcctaacaccaacggcttatttatttatttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttctttaaacagcagctttgtttctcgagtgaggtattaacttccagatttaggtgaaaatgagttccaagttttatgtttcattgtgtgtctaagactgacaccgtttattaccgtggcacttacagcttgctttcaatgcctccaaattctctatctgaaaggctgggtaccatatctcatgtctgaacatagtcctcagaatcatgcagtaccagctatgttccttctgtatattatggcttccgaggtgcctgttaagcagccaggtgaaattgccttttaatcaatataggaaccagtctctttcctggtgatgctaatgctttttataaaaaggccatgctgtattgaagttcttctttcaggacaaaaccactaatggaactcatctacctactgatgggtggaagctcttggtatgccaaagtcttgttttgtttgtgaagaatctctttccctcaacagtgatgtgctacgttaggtctcaaatcattgttgcgttttaatccaaatttatgacaaagattttcagtttgtatgcataatttccttctctggccttaaccatcagtctgtggacttgccaagcaacaacaacaacaagaacaacaagtctgaggtcaagagacactatttagatctcagaatcatttgttgtcatttatcctttgataaagttttgcctttctttctttatgagtatatttcctctcatggtttcccaatctcttgagaaaaagaaagttcttgcctcttgcagtctttctcattagttgaattataccagcagttcagcttctgatcctgtcgagaaatccaccatgaagaaataaaacatttctgattacatggattacgtttcctggattcttataggcattaaacttagttctaggatacaaccgcatgatcttctcttattctcagaacaagaaatatattactatatacattacagtttgtatatattgcagtttatatagagtatatgtatatgtactgtatatatatatgtacacatatatataacagtaaaccctgtaggcaagcaggaaaacttcagaattctcaatgaatccatcattagctgttagtaatgacaacactattagaagtatttcaataatcaaacattgttgtggtctgtatgtgcacccccaaaagtaatatcttgaaattctaacacctgagggcatagtatttggaacttgggagtggaattcttttttgtgctattatgaataagatgcttgcctcttccatcaaatgaggacacagccacaagttaccctctaggagctaggaagttagtcttcaccagacacaaaatctgcttgattttgaatttagtctcctgaactgtggaaaataaatttctgcttttataagccactcagtttatgctatttggttatagtggcccaaagagagtaaaaagacacattatttacctcctttgtggactctctggagttgttgctttaaacttgctttagtgcctaacactgctccaactccctgtcctttagcacacacggataaataattctgctgggaactgacatgtttcactcaggcatccaaatgtatttattatgttgtcaaaatatatagcacttgttacaatgtttccatgttagacatattttgagatatatgccttaacactgtgctgtgattattattaatatctagtaactaatcttaccatatctaaactcaaagttttcacgataacactgccttattagggactgaattttttaaagtatgaagatcttacatcaagtccaaattgattcatctgatagtctcgcagtaaaatcaacgccacagaattatctattctgtttcttgtcttgttgtagctgatattctgtgattggacatattgctaatatctattaaccttagcataaaatgtcatattgaaattgaagaggaatattggaacttggctaagaaagattgcttttcagacacagtgagaactaaaatggaccctctgttcctggaggtatattttacaaaaattgggtgctattataggaattctgtacaattctatcttatgcacttgtgttccatcagtgtcaatcctctctgtattttaaattgactatgatttctttttccatctttctgtttgtcaagtattcttttgctgaaaatttgttattcatgttccaacagaaaatagattttttttcttttaactcattggaaagaatatttagagtctttagtgacaaatgacatggtataaatgaaaagaaaatactgacattgtacttgagaaatactaattaattgggagaatattaattaaaagacattgtttaaatatttctatcacaaattgacagcagaacaatacacaccaccagcaaggtataatagtagatatgagaggtaaaatgattaattagatattgcattttctccagaaaacttattatttagtggaaactggccaataatttcttaggccttaggataattttacctttgattctctagttaatcaaaaatatataaaaatattaaccaaaagtatatatttttaaaatacctacataatctaatgcagtatgtttcgctctcttcttgaagtgaattaaattccttatcactgaccataaaatttaactacatagatgattcttgtttaaaatagttaaaagtgaacgtaaagatcagttttggttttccttttcttacccccgttttttacacttatatttgcctgtgtcattcatatacttttagaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgcacaacaaaagtctttccactccaactcccctttaataaaaacagaatgtaacaaaaatatcaaaatctgtaggaaaataacccattcgtctatgttaaagctatgagatttccagcccaaataaattataagaaccagtatagaggccgggcgcgatggctcacacttgtaatcccaacacttttgggggctgaggcaggcggatcaagagttcaggagatcaggaccatcccagctaacacggtgaaaccccatctctactaaatatacaaaaaaagtaattagccaggcacagtggcgggtgcctgtagtcccactactcaggaggctgaggcaggagaatggcctcatcctgggaggtggagtttgcagtgagccgagatcacaccactgcactccagcctgggagatagagtgacactctgtctccaaaaaaaaaaaaaaaaaaagcatgtagaaatactaatacagtgaaatctggactgatatataaagaaaataaccaacagattttgtctatggcacaaaattcttagaaattttgagatctttagccttatagacctaacaaaatatttattagtttgaacagtgaggtactgggatatgctgggctttgaggctatacgcaaatctaattttagaagtcaggaactgttgtaagcaatagcaaagaatatgtttgatgatcagcttggcaattgttgaacaagcttcattcagcactgtgaggatgtaattaaagcagttgccctgcaatctattcactctcttcactggcgaatggcccaggcataagactagaaggaagatgaactggtttagtctctttgtcagctgaaattttggtgaaagagactactgatatttttctaggatgaagggatcttatctctgaaataccctttgcaggttattcctggctgaaacaaatgcacagatcctttcttcttgatcaattttgctgtcgattctcattttacattctttatttcatttattttattctttagctccagaatttttgtttgggttccattttttccatctctctgttgaacttctcatttggtttgtgttttgtttttttcaagttttagttgaattgcctatttgtcctcttgtaactcattactttcctttaaaacaattatttgacaggaaaaactgcacaaaaatagaaaaatctataaatcacatgacgaagaattcaaaataattattttaaagaatttctgaatttgcagcaaaagtttgctatagagcaacatgaaagcacagaaaagtatgaaactcattgattaaggtaaatatataaaaaatgcagaacatgctaatagtataatagtggtgtgtaaatctcttttattgctagtatgaaggttaaaataccaaagtaataataattatagctacaataatttgttaatagatacagaatattaaaaatatataatgtgacatcaaatatataaaatatggtgggctgagtaaaagtatagggttttgaatatgatcaaagttatcagtttaaaagagtttgctccaattacaagatagtatatataagcatcatgctaatcaaaaagacaaaacctatggtagatacccaaaagataaagagaaatcaaaccatgtcagtacagaaaatcatgaaatctcaaagaaagacagcaagggagaaataaagaaactaataatatgttaaaaagccaaaaaacaatgaacaaagtggcaattgtatgttcttacctatcaataattaccttgaaggtaaattcattctattctacattcaaaacccagaatggctgaatggattacaaaagaagacccatcaatatgctgcctacaagagactcacttcagcttcaaggacacatatggagtgaatgtaggggatgagaaaatttgatattccatgcaaattaaaaccagaaaacagcatggatagctatccttatatcaggcaaaatatactttaagatacaactgtagcaagtgataaagatggtcattaaataatgaaaaagtggtgagttgattaaagggatgaaacaattataaataaatatgcacttaacattgaagcacctgaaaatataaagcaaacattaatatctggagggacagatacacagcaatcaataatattagggaaataggtaaccttattgatactgttgcaattatcaatactccaattgcaacaatggatagatcatttagatagacaatctataaggaaaaaaaacattagacttgatctgcactttagaccaaacggacctaacagatgtatgttcacatttcatctacagctggagaacaggtgttcttctcaagctaacaagaaacatcctccaaaatagagcatatttgaaattacaaaatgtcttaatacatttaagaagattgaagttgtatcaagtatcttttttaaccacaatggtatataactagaaatcagcaacaggaggaaaactggaaaattcaaaaataagtgaacataatgcaatccttaacaaaaagtgttttaaaaaggaaatgaaaaggaaaataaaaaatcttgatacaaaaatgaaaacacaatactccaaaacttgtggcatgcagtaagaccgtgctaagaagaaaatttgtatgacaaacacctacattaaagaaaaaacatctcaaataatctatcattaaacctcaaggaactagataaaaagaagagcaaactaagcccaaagctaatacaagaaagcaaagaaatatcaaagcaaaataaagaaatagacagtagaaaaataatagaaattgaaagactttctgtgttcatcaatgggagaaatcaatactgtcaaaatgctattggacaaaacaatctacagataaatgtaatccctatcaaatgtccagcggcatttttcacagaaacagaaataaatactaaaatttgtatgaaattacaaaagactataagtacctaaagtgatcttgtgcaagaagaacaaacaggaggtaccacacttctcactttcaagttatattacaaaactacagcaaattttatatatactgacatgaaaacagtgacatagaagaatggaacagaatagaaagcctagaaataaacctacaccaagacggtcaaaaaatcttcaataacatgcccaaaatacctaatggagacaggatagtctcttcaataaatagcgtttagaaaaactgcaggcccacatgcaaaataatgaaatttgacagttataatatgcacaggaataaattgaacattgaaaaggaatttaaacttaacatctgaaaccaaagaatccctagaagaaaccaggggaaatcctccttaagattgaccttggcatgattttttggctatgaatctcaaaatatagacaagacaaacaaaaataaacacatggaactacaccaaagtaagaggttgctgcacagtaaaaaaaaaaataataattaattaattaattaattaattaaaaaggtcacccatggaatggtagaaaatacttgaaaacaatatatctgataatggattaatatctgaaacagataagaaactaataatcagaaaaaaatcctgattagaacatgagcaagagacctgaacagacttttttccaaggtagacttgcacatggccaacacatgaatgaagaggtgcacaaaatcactaaacaagtgggaaatataaactgaaatgaaaatgagatgtcacattacatcttttaaaatggccaatataaaaagccaaaagatagatagtgttgacaaggatgtatcaaaacgagaatgcttatagagttttggtgggaatgtaaattggtacaaccattatggaatacagcatggagggtcctcaaataattaaagacttaccatatgatgcagcaattatacttttaggtataaatttatatacctgtgggtgtgttggctcacacctgtaattccagcactttgagaagctgaggcaggcagattacatgaggtcaggagttcaagaccagagttgccaacatggcgaatccctgtctctactaaaaaccataaaaattagccaggtgtggtggtgggcacctgtaatcccagctacttgggaggctgcggcatggagaattgtttgaacctgggaagcagaggttccagtgagccgagaacttgatgccattttatataattatcctttcacagacaaaagaaatctaatcactatcttgaagagatatctgcattcctgtgttcattgcagcattattcccaaaacccaaaatatggaaacaacctaagtgttgatagatgagtagtatgtgaattgtgatatctatcatctatctatctatctatctatctatctatctatctatctatctacaatggaatatcattcagtattaaaaagaatgaaatttggccctttgtaacaaaatgaatgaccctagaggatattatgctaagtgaaataagccaggcagagaaagaaaaatactacaggtacaaccatgcaaacttgccattataagatgaataagttagggagatctaacgtacaacatggtaacaatagataataataatgtatgctttaagttcatggagtgtagatcttaagtattatcctttcccaacatgtgataactatgtgaagacatgaatatgttaattagcttgatagtgaaaatcattttaatatatacttgatgggcgcagggtgagaggagagtgagggtcaaaacactacctgctggggactatgctcactagctgggtgatgaaatcatttgtacaccaaaccccagcaacatgcaattacccacgtaacaaacctgcacatgtacctcctgaacctaaaatagaagttgagaaaagaaaaagaagatatcagtttcctatagggagctccaggtttgttccaaacagtagagagacaaacctatcaaggatgaaatatatacaagagtaggcacaacttaaacaatgtgtgtaaggcaatcaattctatataactcagcaactcctaggcttcttatcaaataaaatcactgatgtgtcataacttctaaactaaaaacaacacaaatgcccattcacagtagaatgaataaataaattacttttgcttcccacaggggaatacggcacagcaatgaaacaatgatctgctgctacacaaaatgtagatgattcttacaaacttcaactgagtgaaagaagtcagactcaaaagaatacagatagcaactttccatttatatgaaattgaggagcagggaaatccatcgtgatagagttcatgataatgatgacctttggtgagtaactggttgagaaagtgcaagagagtggttgtgggagctggaaatactccatatcttgcttgatttgagtgatgatggggatatatacacttataaaaattataatgctatatgcttaagatttatgtattttactatttgtaagatatatattagttgaaaaaatgctgcagtgtaaaggaaaccagtaaaaatatgctacctagaattgtagatttgtttaacaaaaaagcatttgagtagtctattgattattagttagcaagtttatattaagcatcattgtcctgaatactttttagtatgtaccagtaagtgtttgcctttctcaactagggctaattaaaaaaaactcaaaacctcatgttgtacacattgaatatatataattttaacttgtgaattataccaccataaaactaaaaatctaattaaaatgagttcgaataaattttagggaaaataggataatgaaaattatgagcttaagaatatgcatagataaaaaataaactgttgatagaaattttattgttatatttcagaaaatcatataaaaagctgtgctaaaagtttccagagagagagtacatagttctcctgcagtggattaaaatgagattagcattggagtactagtctaaaaccacagatagagtctggagtcagatctcagaaatacaatatatttgataagtaatgagagacaagttatttaaatttttgggacctaaacatccagtctgtaagtttgttgaaaaaaataaacaggctaaagagaccttaatttacagggagggctaaattattacctattattgtaaaacataatagcagtgacattaaaagcttgagtgctgtagaacaatatattgaaaatcactttttgaagttatatacatatttatattactttaataatttgcacaatgtaggaagaaaagcttgctttgcacaggcaacattttgccaaataatctccaaatcatcatgaattctcaattagtcagattaacaataataaaattttattgtagaggaggattattttttcattaatatatttgtacctacacatagtgtatatgtaatattttgttacctgcctggactttacaatgatcaattcaaagtatccggggtgtccataacctcaagtattatttccatatgttaagaaagtttcaagtcctttagctattttggaaaatacaatacattgctgtttatatgtagtcaccttactctgctatgaaatattagaacttatgtcttccaagtaactgtatgtttggacccattaacaaacttttctttattcctcccacccacagaaactctttccagcctctggtatctatgtattattctattctctacctccatgagatcaatatttttagctttcacgttctattcttagaataagaacatgtgatgcttgtctttctgtgcctggcttatttcacctaacacaatgacttccagttccaaccgtcttgctgtaaatgataaaatttcattcttttttatggacaaaaactcttccactgcttgtatatataccacgttgcttttattcattcatccattgatggacacaggttgatttcatatctttgctattgtgaatagtgcaataaatatgagagtgtggttaactctttgatatactcatttattttcctttggatacatagctagtaataaatagcttgcacctctggtctcagctacttgggagactaaggcaagaggattacttgagcccccgaggtttagattgcagtgagccgtgatcacaccactgcgttccagcctgggtgacagagtgagaccctctccctcctcaaaaaatccttaagaaatatgttgatgcctggttcccttattcagaattttcatttgatgtgttgagagtgtagcacagaagttggaataaacctctcaaactgattttgatgtgcaaccaaggtcgggaaccaccaaggaagagtttttatgcataaagattcctatactctatcctagaactaatacatatgaatctctgggaatggagtataagactcggatttgaaaaggtgtccttagttattctaaggactgagcagtttggatactggtttgttagagtaaaatggttaggtacctagtatcaacctagccatctaaccttatattaacaactaggaaaataaagggttggagcctctgtgtttctttgctgaaaaatctgctgctattcttagttctatgaaaacaaattcaaaattcggttattatcaccttaaaagtacaaaacctatagatattgaaaatgcaattatttttctacaggcatagttaaaatgagtttgtatatattataaatcagtttctttataagtcatttatttagataaattttgttatactgacatgattcactaattttctaaatataaatggttcagctctcagttatttttaaactaaagagctgtgttatacttattatttctaattggcttttatgatgttttaggtttcttttgaatcccgtgtccttcaagtgctttccaactttgagaagaagaaattgaccacccggactatggaactgtgcgtaacagctttgaaagtgtatttaaaaattaaatctgtatgcctttaaatcagtgaattggaaatatattacatgtattttaatgactttcctcaaatacaataaattgttttctttccaatggaatggtgtttgtattttttctttacctggtttaacacatgtaggagaacataactagatgattacatcaaattctttttaaggcaattttataatatattttatttatgattacaaaaactgccttttaaaagttcttgcctggatatgaatgcagtttcacattttttaaattgtaatcttgctttttgtaattattttatatttgtctggcttcgagttttattgggttttagttttttggaagtgggggatttatcccaatttagaaatttgtatccttgccgtaatacagtctaccatttttgttctcccagatctttcatctgtcagaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacaaaacattgaaaaacttcaggaaagatataccctgtacccaacatgaacgaggtcaaagcaatgaagaaaaagctaggaaatcaaataagtctagaacaactgtgactaatatataaagatttgaggtggttatatccatttaaatggtatcaattagaaaggaaaaaaagaggccaggcacagtggctcatttctgtaacgccagtactttgggaggccaacacaggcaaatcaacctgtggtcaggggttagagacaagcctggccaacacggtgagaccccgtctctactaaaaatacaaaaatatttgctggacttggtgtcgcgtgcctgtgctcccagctgcttgggaggctgaggcaggagaattgttttgacccagaaggggagattgcagtgagctgagattgcgccattgcattccagcctgggtgatggagtaacatccaaaaaaaggtattttacataagaaattttattttatttttctgtaaattataaaatagcacttaatatggaatttatataccagaatctttgaatatccaaaatttaagatgagagcaattttgagaaacttttcaaagcttaggaaaaggtaactacataaaacaccattatgtgttatttatgggtacattagatgaagtaagtcacaaaaacacgcatagaaatgatcatataaacttgcaagaaattgaatgtcttgctattgaaggaaaggttgaggtgtaagagattgaggttgagtgtgagaagctctgtatatattgtatttttcttaaaaatatatatttaaactcacatttcttgtttttcaaatgttcactccaatgaaaattcttttacttttcctgttagaatttttatttccactctcacatatgcagtgtactattgttcagaaatattagtgatcctccttgcaaatgaatactcccatcctgctgattttcagaaggtccaagtgatttgctttggctgtgaaatgtaagcagaaagagtgttattttggggacttcccgattgcaaaacaacatagtatcgcaacttttgacatagcatttacgttgcattagtcattataagtaatctgagatgatgtaaaggttatatggaaatactacattttatataaaggactcgagtagttattgctttaagtatccatggtgggtcctggaaccaattcctcatggatatggaggcacaaggaaccactgtagttaaacaaataatcactttaaaacttaaaaccttttgcatggtgagtacagtcatgcaccgcatatatgatggtggtatagttaagtttattatgccatacatttattggaagtttcctatgtttaaatgtattgagatacacagctacactgctttacagttgcctatagtattcagtaaaataacatgctttacaggtttgtagcctaggaggaataggctatgcaatctaggttaatgaagtccattctgtgatatttgcacagtggcttaattacctaagggctttgtcttcagaacatactcctgtcattaaggaatgcatgagtgtagttggacaaaaaataataatgcaggcatacctttggcactgtcctaattcttaccaacatccatgattgcttaaatttgcactggaaagacttcaaaaaacagtgatatattaggacagtatatttccaatacatgacaaatgataacaacataagaactcaaaacattcaataagaaagaacataacaattaaagcaaaactagatgggaaaaggaagaagcaaatttcaagagaaaactcaaaaggccaaaaagtgtgaaatgatgttcagccttgctagtaattgggaaaaacacaaatctctttttttttttttttttttttttgagagggagtcaccctctgtcgccaacactggagtgcattggggcgatctgggctcactgcaagctctgcctcccaagttcacaccaccattctcctgcctcagcctccaaagtagctgggactacaggggcccgccaccatgcctggttaattttttgtgtttttcgtagagacagggtttcaccatgttagccaggatggtctccatctcctgacctcgtgatctgcctgcctcaacttcccaatgttctgggattacagctgtgagccaccgtgtctggcccaaatcatttttaatctattaggcaaaaattagagctatgataatattcatttttggtgggagtgtggcaaaaggtactataacagaatgctactagagagtaaactttgatacatttgtaagggcaattttgcataatatgaaaatttaaaaatatgcttccagtttcacatacgtttatctagcatacagaattacccatgtgtaaacatgtatacagatgttcattataacacttcttataaaaacaaaatatttgcaaatattcatatgaacaagtgcatacatatgatcttagtccagttagaattttctgttttatttcaatcctttaaaagactcaacttctgattctatataaacaattcaaaaaagaatgtgttttccctatgtgcatttggtcaggtaaattaaaaaatacacctcatgctagcctcacaaaactggaataagccttgggaaagaagttgtccttgaagcttgtatctgacattgtagcaggacgagccgcagaaaaaacctctcagacactgagttgtagaaggaagggctttattcagctgggagcattagccagctactgtctctaaatctgagctcctggagtgcacaatttctgtcctttttaagggctcacaacactaaagatttcacatgaaagctttgtgattgatttgagcaagcgaggtatacatgacaaggactacttgccccggtggtcagggagaaacagaatatggaagagagtttcacaatgttcttctacacaatatctggaatctgtgaatcacatcggcttctaaatcataagtggatgttcaactactgggtttaggccaaccaggcccaggtctgtttttgggcctggcgccgggctgcctgtctttggttttatttccttgttgtttttactgaatagaaaacaatgtaaaacaagaggagagggtctttctcctctctcattttctttctttgagactttcactcatttttattagtgggagctgtcacttttatgatttatgttcttctgtgcaatagattgatagccatttatattgtatgcttgtgctgaaggcttttggtgaaataagggagagacgaagttttttatgatttggagaaacacaggtatcagacaagggagcagtaagcaggttcctattactattattacctctattataagagttttaaatcctcctattgctgggaactactttctaaacatggctcctggattgagtctgtgccagccttgcacgagtacatgtgccagttttgttatatccttaagtatatgctcaactacttgttctttatcatctatgtgtaggcaacatgtttcgtcagattctctcgccaggcaagaacagtcaaggcttgttgggttttattagtaataatttctaaagcagcttgtaaccatatgagcatgtagataggggttggatatcctcatgagccatcttgtacttaagtggcgggtccatagtattgtatgattctttcaggggtgcattcatcatctttctaaccacttatggctatgcttcattttgcctgggaagcatagactgggaagcctacaagttcaactgtttttatgggcagtaagaagaaagatggcttcatggtgccaattacacagccacacgcccactggtcaggcagcttagcataagctttgtgtctacatatctagcataacctagtgggggccgtccagtcctggtggaattctggatgggcctaaacagtctgcaactttggaaatttgctgaatgcatttctttctgtgtaattggaactgtaccatgtaactgtttttgtggcaccattatacaggttttgcctaagacaaataagccgccttacgggatgagtaaatccttttctttctctagctacgcattactgtctaataattgtgacttttagaaactaaaaattgtcggggttgttcttttgggatggaattcgtgaggaactccatctgtaggaactaattcttgggcttcttatggccattgatctcctgttacagtccttccacaaacatcacatgaaatgacttgtagagactgggctacatgtttggctaattgcaaaaacaaatttttagtttttttcagaaatttcaggtataggcacattgaattcatcatagaaagtgtgaaatacttgtcctggtgagcgtttttgaacttcttcttttatcaggatgcttacactagaatctagtccttttctatcaatgcctaatgttatatattttcttttattccactttggatctgaggggtttgtgatgatcaattttaaagggttgcagctcccacttgtgcaagaggggctgacttttcttttttggagccaaacaggatcttttttatctttcttctaagtagcctaactgacgcaataccactattgacacatcgaacataaatatggttcttgacagatgtacttattttctgtgtgtaatttttcccaaatttagagaaatgcatcttatcctctgctgtttagtattaatagtggcacgagcatcaaattttaaagttacatttgtggggactcttctttcttctgttctagctatcactttacttgtgttacttagagaaggaccagttcttagtcttacttcgaagactgtgatcatgggggtttagaggggtcatagcacacatcgggctggtcacttcctggattacatacttagtactgggtgttattatacaaacaggttctgtttggagttcttaggcattcataatagctgtaaaataaaacgatcatcttaacttgtccttcttcagtgtcctgatgtatgcactgaaggcagtcctctgtgtgggaagaggtagtggaagcttttaccacacaggtccatgttataaggacaataagtcctacgacgattttcctcatgctttggccatgtgtagtctagtcagcttcgtggtgtgattggagcagggcttgtcattttcttcaaggtcacttttcagggattgtccaagtttggtttggcctcctaggtctcagcggctgcaggcttcatgaggctgtggtgaatctaggctgggattccttctacattgacagctgtgggagtggtcaggttaattgtctggggtcctttccactgtggccacagcggagccacgttccagtccttgatccacacaatgtcacctggagaaaaagggtgaactggggagaatcagctgcctgggcacctctcatttactcaagttgagatagtctgagtaattttccctaaggcctgtagctgccgctgtaatgcaatctcacctaactcttggggagtacctggaagccctcccagtatgggaggaggcctatgatacagaatttcaaagggggagtatgctgttctcttagaaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagtaagtaaacactagaaccagtaaatacttgttacttctacatttaggcatttctgtgaagtccacttgaagatcttcaaaatgagctgctccagaggcttctattccccgaggtacagaggggccttgcttcgcattgtgctgtccacaggtaaggcatcactgcgctactgttgtagcaacagctggcaagggtgagatgtagaaatactggcctaacagcttttcaagtgattcttggcctcaatgggtagtttcacatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctggtaaggagtagatgctgcttttcctgcctctgtgtctgctcagggctttccttggcaaaccgaagcggaaactcgctgatatcccctgcaatgcatgaatgccaccttttggggtttctacactgcttctaatcattgtagaatttcttgctgacattttatgtcttttcctctagaattttttccttatacaatgctccacatacttgaagggttagaaaggcatatcaagaatcagtatagatgtttacaatcttaggttcactgagttccagagcccgagttagaggaatgagttctgctttttgggctgaagtgctctgaggcaatggcttagcttcaacaacatcatctaagtttactactgcatatcctgcacacctttctctttgcgggttgatgaagctgcttctgtccatgtagaactcctaatctaccaatgcctatggctggtctcaaagatctggtctgctagaatagacatagtccaacacctctacacagttatgtttaacagggctgtctgatactgggagcaaagtggcaggatttaaagaattacagacttctatggttatacattgattttcacataacaagctttggtgtttagttaatgtagcatttgttagccaatggtgtcttttggtgttccttagagttacattagagtcagcttgggctgacataagtttttcttttaacttataagtcttgttgttgtagagacctctatttaaaaggctctcggtcaccccctttataactccattcaatgctttggctaacaccacaaagtttggaatctgcagtctgcaaaaatctcacagctcctaaatgttctcttatttgcctcctggttttaggttctggtaagctgcagatgacctgctttcttgctgaccatagactgcactccccttttcaaatagtgaatcctaggtagtgtacctgctgtctgcagatctgagctttctttttgggcactttatatccacagtcctccaggtgtcgaagcagggcacccgtcctttttgcacacctgactgccatggagtgtcctagcagaaggtcatctacatactggagcaggatgcaacctaggtctttagcaggaaacatttggaggtctccaaccgaggcctccccaaagatggtgggggactttttgaacctttgggaaagtcgagtctaagtgtactgaatggtgacatctgactccggatcttcctactgaaaggcaaacagcttttggctctcaggaactagcctgatgtgaagaaggcatctttcaagtcctgtacgggtcgatagtctttggtccttggtttagggacaggtaggaggtgggtgttccatggagactggcaaggaactagaattccagaggcttttaagcatataagatgagtctctattcctttaaaggcttccctgggaacaggatacggcttttgtccaattggctaggtcgtaggctaaacttctatgagtacgggggcttgattgattgccagcctcagaggattgtcctccatctctactcagagccgtcactcagctggagccacttttatttcctgagctggctcagttagcaaaagtctccactcttcttcctgggggactggaagggccatgatgactcctgtttctggcaactccagctgtaaagtgccttgttttgtcaaggaaatggtggctcttaacttgctaagcaagtctcttctcaacaaaggcaagggacagtcagacatatacagaaatggataaatcactttgtgtcctcccactgagcagttgcgcggtagacagaagtcctgcttggtagagactcctgttgctctaattctatcaatggtctttatagatgagggggccactggagtgcttactactgagtgttcggctcttgtatccactaaaaacttaatgtccttgccccttattgtcatcctgaccatgggctccttgggggcatttgagcctgttccccttaattctagcagcccctcagctagattgaacaaaatcctttcatcttggtttgaggtctttggctctgcatcactctgattttctttgagttggggacatttatctttctaatgtcctatttctttacagtaggcacattagtcatgctgcaaatgtgagtgattggacagggcattcctcccagaacccccttttttctgccttttcaggagaattcctctaattgtcacagccagcaaactagcgtttcacctggcctggcgttcgccctccttacggctttcttggccgcttgttgcatctctatttacaaatacttcattagctctttccagtaactgcaaggttttcattcctgcaaacctagcctgtttttgcaattttctctggatatcttctgcactctgaataactaaggccgtattaatcaacggctgattttcaggactctccagatcgaaaggagtgtacatgcaataggcctcacacggtctttgatagaactgggctgggctttcctcctttccttggatgacttcagaaactttatttacattggtacccttttgagccccttttttcaacctttcaattaatgcctctcggtaccctcttagcctttccatatctggtccttcatttggatcctattgagggtccgttcctggcagctgaattcttatgtattcttggggactttgataattggctgggatgtgctcctccagccatttaactgttgcctgcagcacctgttgccttttatgtgttttaaagaggtacatgagtagctggtggcaatcagcctaagtaggattctgagtctggataattctttgaagcaagtcaattagggcttgaggcttttcagtgtaagatggagtgttatttttccagttgagtagttcagcagaggtaaaagggtgatacacaaaagcatgcctttctaccgtatgtctgacctcatctgtcctagtatatcgctgctctctcagggcatttgaattcccgtcttgggccgttaagcgggctgccagggaagtggattttcccgcagtttcacttttgttcttgtctactctgggtggtctaggggctgtgggctcaggagaagggggcctccccactggataaggggttgagggcactgttggtgccatctcctgccttgagtcctcgagctctgggtcaaacagaactttaggtgctggcttctcttggccggtggagcgagaactttcctgaaataaatgtccctttgctactactactgctgctgcctgtccttttaccactgtagaggatctaaaactagctgtaactaggaatctctatatggaaattgatatgggtgcaggcacaccatgagcgatcaggccaagcttccgctcaggtggagtggggcaagttgaaaagacttgtcttactaagtttcagatgtctggactccaagtgccagttccttcctggtgttcagccactgtgttaatcctccgcggggatcactgctctggcgaggcgttcaaccggggccatttcctacctgggagcgctctttggatcccatccctcaggctggccagagtccctggcagcctgagggatgccccggccttactccacaaggcatgcctaatctgcctaaggagctgcctcggccgtccatcagttatcttgcttccaggtcagggaaccaagaaatgtagcaggacaagcggcagacaaaactctcagacaccgagttgtagaaggaagggtgttattcacctgggagcatcggatagctactgtctcaaaatccgagctccccaagtgcacaatttctgtcccttttaagggcacacaacactaaagatgtcacatgaaagggtcgtgattgatttgaacaagccagggatatgcgacaaggactacatgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaatagctaagtgtgtttcttttcttacatatacagtaatagttacatatcattaattttaaataaaagctctaattagtaaaaagaggtttaagacacttgatagtatgaaatacaattccaggttacacataagttatttattttggcaaaaggatgactcaaaaattttaaaactaggcaacaatctttactcattaagaggtaagacttagctttccaaacagtttgtctcctgtctactcttttctctccttggcattctaccaacaaggcaaaccaaatatttcattattcttctctattacatgaaaaatctgtacaagggaaggaaagccaaattttacccttacataggtttcaaaagaatcctttttccataggcaacatttacatttttatgcctttttataatcttttaccacaaacacatttaagtgttcctacacaccttgcatgtaaatttatttttagttgtcttatttacatatttttatggtcaatcttagcaatttttaactttaatgtaaacctggtaagttgttttaattatgtactagatgcagataaagtctgactttttccattctagttagggcatggttaatttcatatgtccccaggccttaccaagttgtaaagtaggcagcctacaaccttgaaatatttagcaagccttttatctaatttatgtgatttaaacctgctatttacatattgatgatatttgcattttccaatttgatctttaaaacagtttttatttcttagagtttaaaaacacataaactaaaaggcattacggttttaactttcctctaaaatatttgatttaagtgcttatttttatttaaggcaatcaattggtcctcgttacagacatcacacacaacacatatattgctacacagacaaacagaagaagatccagtagctctaagatttcttctcgtcccatttcctaattgcattactggcttcccagtagagccctttaagaacagggatagcaaaccacgaagtttctagggcctaatcaacttgtatagctgtaagacaaaaacagattttgagcaggattgatcagcctctagattctgggattccatgaggaaaacagaggtttctcccaaaatggaatccatcatgcattttctgtttttcccaaaacgtttcaggccaccagaagttatcttgtgtgcattaagagtggaaagacagagtggagaacagtaattcagtcaatggaaaagttcttttcaagaaaaacacgatccaagaagacaaaaacatgcaggtcttttaaatatacctataacttgaatatccacttttaatcaagctcagcaccctttcagaaaatcctttgacatcttctgtttcctgactttagctaaatcaagcaggtaatatttctggcttttgaattttaccaaaggtaacatcacaggggaaactaaaaactctccgttaggttataagttcaccgttagtatacaagatattttataagtggtggtaagcagcttttaccagatctagaacctttaaagtcagttgagagaaaggaagatttcagaaaggcagttagagtttttcatggcggagcacgagatgattaaacgtcacacagttgttaactggaaagtattcatcacccaggctgggattgaacctgggtcaccattgtaaaaaggcaacggctgaaaagtggtactaccacatggttacaggttatgcttaaggacataaaacaagtcggagacatgcagcaaagtttgttactgaccagtttatgagggtgtcttgaacagtgagctcaaggagtctcaggcctggattccattccaaggtaccctctgtctgactttttcttctattttctctccttttcctgagcctcctcctagtacgtcttatgaaagactgaggtggctactcttagaaggttttctaaggtgccttctagtcctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagagttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatattgattaaaaatcttaaatcaatatttgaaagttcttaaatatggatttgagtttcttaaagtagtcaaacttgttaacttctgtccctaagagatctaaattcctattttaaatgaaattcaattagctacatgtctacaagaaaaggcatatattactcttttattcagatcactctcgtaaaaaaattacctgagtagcatcattgtagttctcgatatctccacttccagttttacatttaccatcattgaaatcccatccagaatatgggactgctggaaagtccctacttccagggttgaagtaacttccacaggtactgcttgttcctgcactcacagcgttaccacacatatgattaattacagcatccacataaatacgaacctagaaaacaaagtttctacttcagtgtgacttacagagaggtagaaatttaaagcattattgatgcaagtttatagtatgttaataaaactccaaaatatttcatg

SEQ ID NO: 1752 - DNA, 111067 bp, Homo sapiens
tataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaacaatagccaagtgtgtttcttttcttacatatacagtaatacttatatttcattaatttttagtaaaagctctaattagtaatcaacttgtaaaattcacaaaaaaaccaatagtattaaaatcccacttaattgttgaataagtgtaagataataatagtcagcaagttgttatgctttagaagactgactttaacctatttaagctatgaactcagaaaagcatctcaaccaatatgtttgttgccattagcatcatttaccgagctgtgtacctttaatttctgccattctataatccttccaaggagtgtttttatcagttagttagggatagctggtttaatgctgattcccatgcaaagttagcccggttgtatgctttttataatatgcaagtacttctggtgttaataaggttaaaaaatagaagaaacctaaattatacaatctacagttatcagttctattgagctcactggaatcttctcctactttatagacttccttctttttcatttttttcctaattgcttagacttgttgtatatgactttttgttctttttcttattctacaatctggatatttatttagggctttcatgacaccttgtagtctgggttttcttcccaattctctacctattcattcttcttcatcttgactttacatatggaattcattagggctctcatctaggtttccttataactctcagttgttttgtttatgcttaaatgagaacatagaggccataactcagaaactgtctattcttcacctataaattgtccctgccacaaagcagattcactgtgcattggtaccacttcggctcactgcatcttgggctgcagtttctactacttaagattgagtccagtgatttagaacatacacacaaaaagttgcatgaagcaggcttattgcttatagataggcatcaagtgacacagaagcccggcgttcaggaggagccagcctcccaagactcagaccgtttgcccagggtgttgaagactcatttgcacatgccctatttgtaccacagctgagggacccttgaaagaagcctgccccgtgttttataacccaggcatcccatgatacactgggctaaagcacttaaggaaatgttctaagaggcacagtaagagagtctgagacttatctcaggatgttgcattcccagctcattctacagctattcttgagatgcacaagttatagaggaggaaaacctgggttgctccaaggccacttggagagttgtcctgcatttcctctagcattttccttttttttctcctattacaataaagaaagtacatgtcattctaagaaaggccattttctctgcttaagttaatgataccattccatttttatcttttggaggactttagattatcctccctcttttgatttagcagtctttccctttcttctgcattagtcatcctagattacatgtattacagtcttccaattaaaaacatcaatgaccatcctcagatattcttctgggtatattactttgctcatttccttgctccctctcctaattaaacatctctttttatcacactgtctccacatcctcagcctccgtcattattcatctctctactgtccagttttcaccattatcacttcattcagtctgctcttgtcaacatcatgagtgacatttatgttaccagtccaatatatttctctgtcctcaccttaaaccacttcatagcagtattaatgatggtgggtcactttctctttctatcttccttttttcgtgttattctactctcctggttgccttctgtctcattgattgctctgtttcaggtttttgtttttttttttatcttattcttaggtggatcatcttattctgttccacctaagtcctaacttttatctatttctcttctttatcttctcttctctaggtgattggaatcatttccatggattttaaacaaatattttctgtggacacctaggtatcttcaattcagaacttggacttcagcctcatacttccatcagatgcttgttatcaccacttccatgttccacagacatctcataattaacatatttaaaatggaaccctcattttttttccttgcataaaccttttactacattattttcttactgcttagaaacccaggatattttctgatttatctctcttagctcaacaactttatctcttcatataaaccttagcatgaactattaattgtatcttcaaaatatctcttcatttattgcacttcttttgtatcttctatcacccctttatccagctcacaattatctgttctctgcattccaaaacaactctgcaactggtctcctatttccattattttactgtctccctttattttactaaagaccacaacattatattcatacaatttaaatccaattaaaatgttaatgcttaaaactcttaaatttttattgcattcagaataattctaaccactcatggtagcctacaaaatcacaccttatcagacatgaacctcagttctattcttttcccttgacaatcccatagccttaggtattctggtctttcgtcattttattaaatatgccatgtatttttattttatgttgtggactttttgtatgtgtttctccactcttttggaatcctcttaactgagttcttagcatggttggctcctgtttttataagtactcccaaacacaggaactagcattaccattttttcagtcctgcagttcagaaatctggggcttacgtttgaaaccctcttctcttacatttcccagaacaaataaagcactgaatactttagatttttgcattctatttcttcactatattattttctctttctacttctactatctagtaacccttttcttcaatgaccaaaatctattttacttccagcaatatggtgaaaagactatcgactcttaatttaaagccagactttattgtttataacaaatgcattgcagaatgtaaacagagaatgtaatcacaagccaggggctgggagcacttcatattagtttcttaacatgtcagaaccacattctttcatttttataagagagtaaccagagagccactttaagaatttttagtggttagcagaggagtagaggagagtgcccttgatacacaggtagtggtgaacatgtatctttacccccagcaggagagaaaagataaacattagagacataagctagcaagcttcaaaaaggatatttgaaaggggttttgtaatgggatatcagtttttgtacaagggaatttatttgtacaagaggttacggagcttttctcggagaataaaacaagcctgtctattacttgaaattttaacttttagaatagcttacgtgcacttatgctgattattgaggggttgactgcagcatcagcgtccacttcagtcctttctccaaccattccattatctaccatgcgatcagagtgatcttttcaaatcagataaccaccaccacttaccttaggataaaaagccaaaattcttatcagggcttgtaaccctgtgcttgaagtcttacctcactcaattctcctctttaatttctgatctctaaccatgctaatcttttagttactgcaactcaacaagatctttttagttctttaatttcaattcaagagacattctgctctttctgcttggaatgctcttttcttacctcttctcctaattaactcctgttcatcattcaaatcttaattcaaatgctgatcctgcatgaatatttattcagtattaggtcaagtcccctgatgactgttagcaatctctgtacttcttatcactcagcatagtactgtgggaaatatctgcattgttctttattgaatccttagtctcaggacattatccagaatgtcttacgaagagatcaataattatttgtaaaatgaattgagataataataaaagagaaaaataagagaaaaaatgtatctatttttgagaaggagaacatttttaatgaagatgtggccctggaatacagatgtttctctcatttttttcctatttcttcccaaatttaattaatttctggttaaccctgatttctcagatcataaaaatcatggggaaatcaactactttggcaataacccatcatgttttcaggatttgtaagccataacaacagtaaattctttggtgagctatactctcagtaagtaaatgaagaataattcaaatattattgggaaaatgatgccacattcatctgaatataataaatgtgaaattcattttactatgttcttagaactttgtaatactaatttataatagcagtttcatcctttagatatttcattttatctacggatctaattcttcctgtgaaattactgagctatttctctattcttagaagagaaaataactctttgtgataaaaatcattactatgtataattagacttccgtttacaagtcaaactgaaccaacgaacttacaatcatagaatgtgactagtcacagggaatggttggggcattagctcagtacctgtccaaagtgagctcattattatgattattagtatcaccattatcaatcagcttccacataaagtgtacctaaatgctagatctatatgatagcttccaaaatgacactgatttttaataatccaaatctttaaagagatcactttccattttagaaaaatgagatttttttttttttggaaaagatagaaaaacctctaagcattttaaccaagggttttagaacactttatttttatgaatatatcaaagcaaattccttctttattttgaaagtgactggaaacaatttcacggtcttactaagggctagtttaagtgagtctcaatttttcttctgttttgtttgctcttacaactttcctcacacacacacacacacaaagggagatataaaaaaatctagatataacagatgcaacttacaattttttggtaagaaatcataaagttttagaaaaaatcatttaggagtgtcaataaaaacgatatttaagaaaacagtaggaaaagtgatatattaaaagacttttaaacacctttcacaagaaattgaacagatgtgcaaatacacattatacgttatctatttgctcattttatcctgtccttaaacataaactttgaagataaaagaaagaagtgtggctcagggtcactcatgtaatctgtttttaggcagaaacaggtgtgttgaaaggtttttaggtaaaacaaccaccacttagacttcaataaagtagtatttattattttcctataattgcaaatttaccaaatgtaactcactattttttctttaatattttcaaagatatttttgagtaattattatattttcacaatcaattcagtagacatttttgaaaaacttatctgaacctagttttctcatctgtgaaatggaaacaatatatactctctcagtttgttgtgtcaaatgagaaaccatatatgatatactaaccactggttctggctaaatgcatacctcctcatcttttcagtaaagacatgactgttggccaggcacggtggctcacgcctgtcataccagcattttgggaggctgaggcgggcgaatcacttgatgtcaggagttcaagaccagccggaccaacatggcaataccccatctctgctaaaaatactaaaattagccgggagtggtggtgcatgctggtagtcccagtcccagctactcgggaggctgaggcaggagaatggcttgaatggcgctgggagattgcagtgagccaagatcatgccactgcactccagccttggcaacagagtaagactccatcccaaaaaaaaaaaaaaaaaaaaaaaagtaactgttattctcagtactttgggccagcacagtactgatactctcctaaaatctaactcaaagagaaaaatcacaaagcattggaattggagcagaaagtaatgtattcttgtttgacatctttccacattcagtctgtgtactgttagctgaaagctagttgacacaaaatgctgtcttaactttagtgttgtttctaatttagttctaggtcataaaatttgtaggaaagtctaattccaaaactttatcaacagctttgttacgctcaggtattatgatcagatatcttatgtgtgctctatgacctcaagcaaagattaaataaatctgtacattacagtgaagacccacatcaaccaatgcaacatacatttatttttcgcagcactcttttaggtgctttgaaacatgtaacccatgtttaagtgcagaggatagctggcaaggcaaaatataactatatgatgtgttaataagaatacagaggaatagttaaagtgatgcataataaagtacggaaatatgttgtttgatttcaaaggaaggggatagtacatatgctgaaatggcctgggaaagcttaatgataaggaaggtcttgagatgggtaagagagatttgtaaggaagagaaaggagggaaatttattccaaaagaagaaaaagtatgacaaaagcacaaaggaataaatgagatgaatggcagaaaatagatcagttaatcagtgaggctagagaagcacgtttatggaacactagtgaaaaatatgatgaaaaggtagaatgtgaccaataacagaaggatccattttctatcaagactttcttattagatttgatatgttcataccagcaatgtcatctctgaatataaaagatatctgtacttacgcaacataattatatgttatcactgggaaattctaggaagtaattatcagtccctttattaatattactatagaattaacttattcagttatagggtacactacgtttatagtttacttccttcctcccccagcctccagctttgtaatttaaatgaaactaaattccatcataattcactcactaacacataggactgccaacctctgaatggctttagatttgcgtgaacctgtatttgtcaatgcttgctccaggattctattggcatatgtcgaaataattgatttttatgacaacctgcttcctgcttactgttttttaccatagggagggaaaaaatagaattatcccttgatttagctgtcagtcaaatgacaactcaagcatgctataaaattaaagaaagccccacattctaccaggaactgatgattttagtgatactgctctctttgtagaagaaataaagtattttcatatcttatgatgaatatcactataatacattaaaatatagaattgcatccagcaaaatatcctgaagtggacaaaatatgcccctccaaaatatgccatttttgcacaataatttttttgagcagaaagcaattagctcactgactttcacctttctaaaagcaagacataaatttcaatttgtaaagacgtctccctttagtgtacttgtaagaaaactactccatagacaactcttaatagctgatgacttatctgcataagaaactttattaaacaatcctgatttagaatacatttcttcccccactttcccgtaacttacctcctgcaccgagcagccctaaacttcttttctttggctagtctaagatatacaccccaaatcctaattgcctctttgcatcacatttctttgtgaatttccatgtgtatgtacataattaattgttatttttcttgttaacttgtctgtgatcagtttaatttgtagggtcccagacactgaacctaggatggaagagaaaaagtgtttctgctttcctatggcttaggcaaccatgaatggacaggcagggcatcccacttgctccagaggctgcagctcaattgagatctgacaaagctgatgtgaaaactttactgaaccagatcctggaattttgcctacaaaaatacaaatacagaactctgttttttcttttccaaattcagatttgcacgagaataaaattataagaattagttctttggaatgtgattctggtgaattttctcctgagtatcattggttattgaccctttcactcccagggagagccattgctttcctgtgtgtctcattttgtgtcttgagcgcttggattcactttcttcctggtggcagggtccacattgttgggcttgctgtacaggcagtcagtcatcagattgtatgccctgagaatttgtagatggtcagatagagatgcaggttgcactgtcttgctactgatgttctaccaaccctctcagagggtttgtctaaatttttatttcttttggctattgctgggaggaactccatatcataaggacttcatttttgcactctctttgtggatacctcttacgttcttggctatctacattattaaatatgttttttccctctcttattaatcttttatttatttaaaagtggtgggttcccatggccttgggcatctctgcctctgtggcttcacagggtatagcctcatcctagctgctttccccggctggtgttgagtgtctgcagcttttccaggtgcagggacaagctgtcggggaatctaccattctgggatctggaggaaggtggccctcttctcacagctccactaggtggtgccccagcagggatcctgtgtgtgtgctctgaccccatatttcccttctttactgacctatgagagtttctccatgaaggccccgccactgcagcaaacttctgcctggacatctgggtgtttccatatgtcctgtgaaatctagggggaggttcccaaacctcaattcttgacttttgtgcacctccagctcaataatacatggaaaatgccaaggactggggctaccaccctctgaggcaatagcctgagctgttccatggccccttttagccatggctgaaggggctgggatgaggagcaccaagttactaggctgcacacagctcaggggtcctatgcccagccgaagaaatcactttttcctcccaggcctctgggcctgtgataggagagtcggctgtgaagacccctgacatgccctggagacattttccccattgcctttgagtttaacatttggctcctcgttacttattcagagttctgcagctggcttgaatttcttctcagaaaaagagatttgccttttcaatcatatcaggctgcacattttccaaactcttatgctctgtttcccattttaaaactgaatgctttaacaatattcaagttacctcttgaatgctttgctgcttagaaacttcttctgccagatacactaaatcatctccctcaagttcaacagttcacaaatctctagggtaggggcaaaatgccactagtctctttgctaaaacataagaagagtcacctttgctccagttcccaacaagttcctcatctttatctgagaccacctcagcctggattttatatcattattgacattttactcaaagccattaacaagtctctagggagttccaaaccttcccacactttcctgtattcttctgagacctccaaactgttccagtctctgtctgttacagagtcccaaagtcacttacacatttttgtgtatcgttttagcagcacttcactcctggtaccaatttaccgtattagtccattttcttgccgctgataaagacatacccaagactgggaaatttagaagagaaagagatttattggatttacagttccacgtgcctggggaggcctcacaattatggcagaaggtaaaaggcatgtctcacagggcagtagacaggagaacagagcttgtgcagagaacatccccttttttaaaccatcagatcttgtgagattattaactaccccgagaacagaacagcatgggaaaacctgccaccatggttcaattatctcccattgggtccctcccacaacatgttgaaattaaaattgggatttgggtggggacacagccaaaccacatcattggggatggaactttttattgtgagtatgtctgcacaagttacctgtgtagattttcttgtctgtgtggctgtgggaatgtcttagtcaaacacccctatgcaagtttacttatctatgactatagtttgattttttaggctgttcttttgtttgaatgaattcaactgagtacccaccctaactgcctgcctgactggtttgtttatttctcctctctcatttttacccacgggagtggagagcctaactgctgttagcgaggtggggtgatgctcgctacttcctgctggaaaggggcattgtatggggaacagcagctagggttccttctgtgagctttctaagggtccttggaagaaatttgtgtccatgcatggtttcatttgcatcaacatttgtagtttgatagactttaggcaagaaaaaaaaatggattattagaggacatgtataaaaatgaaacaaggggataggtaatgaaagctcaaaaatctcaaggcttcagccatgcccagataaatagtggctatagttatgcctactaagatttgggtgcatggggctttgctttggtgaacttccttggttttattttcccaaacaaagaaacctctgggttatgggtaccctgtatactcccataacctggtaggatttgcaggataatagcccaaaactagaatattgattcagatttttacactacttattccttttttattttgagttgcagccagagattgctggtttgtttacaggaataagcagagttattctaaaatgtacgtgatatggtttggctttgtccccacccaagtctcttctcgaattgtagctcccataattcccatgtgttgtgggagggatctgtgcgagataattgaatcatgatgggtgtttttccccatactgttctcatggtagtgaataagtctcaggagatctgatggtattataggaggaaatccctttcatttggttttcatcctctttcttgtctacttccaagtttttgccttccatcatgattgtgaggcctccctaaccatgtgaaattgtgagtccattaaacatcctttttaaaataaattacccagtgtcagatgtgtctttgctagaagcatgagaacagactaatagagtaggcaaaacttaaaaacaactaatgagattagaatttaatgacaagtgtatgataagttttgaatcaaattttgctctctccagtcctcatttttgttcaaaacaaatcatgatagtcattttgttaaaaacaaattacgactgagttgtttgcaatgtaaacttaggctcatacttggcttgattatttgcataatgtgcagcaaaaataattatttttgcagtcttttaaaataagctttgatggaactctgttccacaagagatctcagataggacttttttaaagccaagcccggccatgagtttgtaccctcaaatacctatgagttgagtgaattcctctcttcttaatgtcacaagaatatgtggttcctgggactgttatatagtgacattctttactcatcacagattagaaaccccgtacacagattatgtagacaaggtaggaggccacatttcccaatgggcttttattggctctgtaagtgaagcttgattcctcaaagagaagcatatccatccaatcaaagccttggtaaaacaaccagtttctccaattgtgtcatgttgcaaaagaaaatgaattcttactgcactggtgcaaacaacgatattgccataagtttagaatattcccaaatagtttccaaattctggagtaacttggcagagagaaacaaatacgctccaaattttgttcactggtgtataccttacttaattcttaaaagctgtagatagcttaaaagaaaggtttccttaactctgaagaacaaaacaaagaacagcaatgttttaagcaaaaagtaaaaaaagattatttcagacttctattagtttagttcatgcagttaactcctgtctgatattcataaacagttaagatcttcatgactcttgtatgatttcttttattctcatgtcatgatttccaaagttatcagaaacctgcatttgagagcacattgtaaagtcctacagctgattgtaaaacatcttttgaagaggattaaaacaagacaacatttatctgtagatgacatagtgttcaggttagttacagtgaaaaacatgactggcaaagatatttggttatttctgtggtttgcaataacttaatacaataatcctaattatgatccatagcatattctcaagcattagaatttttaaaatcccatacaattttggaacatatattaatattatcactaaaatataacctgaataaggttaaacataattttgtcaatcccacttacatgaacctgtcaaaaaattctgtttacttctcttctggatgcttcagggccctctgtagcatacaaaaggtagggttcaggagagacaattttgaatgtgaagtttgattttgggaagcctgtcaaatgttacaggtttaaaacacttgatagtgtgaaatacaattccaggtaacacataagttatttattttggcaaaaggatgactcagaaattttaaaactaggcaacatcctttactccttaagagggaggacttcgctttccaaacagtttgtctcctgtctactcttttctctctttggcagtctcccaacaaggcaaacaaaatatttcattattcttctctattacatgaaaaatctgtacaagggaaagaaagccaaattttacccttacattggtttcaaaataatcctttttcattggcaaggtttatattttatgcctttttataatcttttatgacaaacacattttactgttcttacacaccttgcaggtaaatttatttttagttgtcttatttacatgttttaatggtaaatcttaccaattttaacgttaatataaaacctggtaagttgttttaattatgtactagatgcagataaagtctgatttttccatcatatttaggggcatggttaatttcatatgtccccaggccttaccaagttgtaaggtaggtagcatacaaccttgaaacatttagcaaacctggtatctaacttacatgatttaaactttctatttacattttgatgacatttgcattgtaccaatttcatctttaaaacaattactatttcttagaggttaaagtcccataaactaaaaggcattagagttttaactttcctctaaaatatttgatttaagtgcttatttttatttaaggcaatcaattagagctcattagagacatcacacacaacacatatatcactacacaggcaaacagaagaagatccagtagttctaagatttttttcttgtcccatttcctaattgaattattagctttccagtggagccctttaagagcaaggatagaaaaccatgaagtttctagggcctaatcaacttgtatagctgtaagacaaaagcagattttgagtggaatctatctatgagcctctaaattctggtattccatgaggaaaacagaggtttctcccaaaatggaacccatcatgccttttctgtttttcccaagaagtatcaggccagcaaaagttatcttgggttcattaagagtggaaagacagagtggagaaaacttattcagtcaaaacaaaagttatcttgggttcattaagagtggaaagacagagtggagaaaacttattcagtcaacacaaaagttcttttcaagaaaaacacaatccaagaagagaaaaacataaaggccttttaaatatacctataacatgaatatccacttttaatcaagctgagcattctttaagaaaatcatttgaaatatgctgttacctgactttagctaaatcaagcaggtaatatttctggcttttgactttaccaaaagtaatatcaaaggtgaaacaacaactctcaattaggttataagttaaccacgagtatacaagatatcttataagtggtggtaagcagcttttaccagatctagaacctttaaagtcaattcagagaaaagaagatttcagaaaggaagttagagttgttcatggaggaggaagagaagattaaaagtcacacagctattaacttgtaagtattcattacccaaaccaggagcgaacccgggccaccattataaaaaggcaatggctaaaaagaagtactgccacattgttacaggttatggtcaaggacataaaacaagatggagacttgcagcaaagtttgttactaaccagtttacaggggtgacttgaacagtgagcttacggagtcccaggcctggattccgttccaaggtaccctctctctgattgtttcttgtattttctctcctttttctgagactcctcctagtacctgttatgaaagactggggtggctactcttagaaggttttttaaggtgccatctggttctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagggttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatttcttccaggcagaagctagaaagagaggtttgaggtttaacagactgtcactatatatgcctcccagctgtagaaaattaacttgtctcattaataaactgttcaaattcatttagcagtggtgagcttttacatgaaggaaaagcaactaaaatggagagggatgagggtattcactcgggatgaaatatcttttcatagagtaccatgaatgactgttattgtgggacaaaaagcacttactgggtgaaggtttagactgaaatcttgaaatcccctggtattttgagtttctgcttagcctttccaaaggaataaaatcagatatgtatctatctcagtgagcagaggagtgactttgagtagaatgggaggaaggtttgtcctaggcagtttcccgcttgaattttccctagtgatttcaggggcccagtatattgtcctttcacacatctgacaagtaattgataaccagaatatctaagcagctcaaacaattctagaggaaacatatctaatagttggatcaaaaagtgggcaaaagatttaaatagacatttctcaaaagcagacagacatatggcaaacaagcaaatgaaaatgtgctcaacatcatcgatcagagaaatacaaataataactacaatgagatattatctcaccccagttaaaatggcttttatataaagacaggcaataaggattgctggtgaggatgtggagtaaagtgaaccatcatacactttttatggttatgtaaattagtacagctgctatggaaaacagtttggaggttcatcaaaaaactaaaaatagagctatgatgtgatccagcaatctcacagctaggtatatacccaaaagtaagaaaatcagtatattgaaatgatatctgcactcccatgtttattccagccctgttcacaatagctaagacttggaaacaacctaaatatccatcaacagatgaatggataaagaaaatgtggtacatacatacaatggagtactattcagctataaaaaaaaatgagatcctgtcatttgcaacaacatagatggaactgtacattattatgtgaagtaaaataagccaggcccagaaagacaaacatcacatgttctcatttatttgtgggagctagaaatacaaacagtggaactcatggtcataaagagtagaaagatggttactagaggctgagaagggtggatgggaagcaagtgggaatgttcaatgggtatagaaaacagaagaatgaaaaagacctagtatttgacagcacaacagggtgactatagtcaataacaacttaattgtgcattttaaaataaataaaagaatataattggattgtaacataaaggataaatgcttgtggtgatggataacccatttaccctaatgttattattacacattgtctgcctgtatcaaaatatgacacatgccctgtaagtttatacacctgcaatgtaccaacaacaattaaaaatttaaaaaggtgtatccttcccagtgaaccaaaatattttacattgataacttttaagttatcatagtgtgttggaataatcacagctttggaaagaaaaaaattatagatataaactttcaaagatggcaggagatatagatctctctttagtggattaaaatatgccatttgttattaacatcacactgagattttttaacacaggacatcttctggaaatgatatgattataggagttataggaaaaagcgttttttcatactgtgattacctatgctatgaagaaaggagatatttcctctatgatgtctaatttagcataattattgtttttaaactatatttagatttaattaagagatacacaaacaaattacttttagtagtaagaagatttttaaaaattttttgtgtaagatgactatgtagtaaagaaggttacaaacttactttttaacgtagaaaaataatctcaccttcttgccccatggaaaattgaaatgttatgtggaacccagtgtagaaaaactctcagtgaggttttctgtcttaagtttcagtggattgaggtgagatcaacgcctgttccacctttttcctccctgtcctagcaggcttgaaaacatttatacagccataaaatgttgcctttaaattcaagtatagaaaataaaatttaaaatgtgatatttttatatattttattttaatatcttacatgggaaatgtttttgaaatgttaaaaaattaaaatttttaaaagagtactgtgaaataatctaatcacatgtggaaattttgttactatttccccaagcatttttggtacatttaatgagttgaatgtaactcataagtagataaaaatgtttaatatttaattttctgctgcaataatgttacaaaacaaccttaaattctcagtaacgttaaacaacatatttttttctcccaaatttccaggttatttaagggcagttctgcttcatattgcagtttgcctgggctttactccaggctgtgtgttggagttaggtctaatatattgtatccctacgtatcccagttagaaagcctaacagatttctttgtacttcagtcagctcgattgtatttgtcattcaaaagccaaagcatttatcctaacaccaattgcttcttttttttttttagatggagtttcactcttgttgcccaggctgtggtgcaatggcacgatcctggctcactgcaatttccgcttcccgggttcaagggatcctgagatggggtttcttcgtgttaatcaggctggtctcaaactctcgacctcagttgatacgtctgcctcaggctcccaaagtgctgggattacaggcgtaagccactgcacccagcctaactgactgcttcttttgttctgtagtctttctccaaaactgtttttctctgtactcactttcaccttctctcacacatatatgtccctcatgtccctttatgtctccagggtcttctatttccacgtaatcttaattgttcatcatatcctggactcatgagtaattaatctgttattctccctgaaagtgcagccttgttgaatagaatgtgttctttaaagagcagctttgtttctcgagtgaggtattaacttccagatttaagtgaaaatgagttccaagttttatgtttcattgtgtgtctaagactgacaccgtttattactgtggcacttacagcttgctttcaatgcctccaaattctctatctgaagggctgggtaccatatctcatgtctgaacatattcctcagaatcatgcagtaccagctatgttccttctttatattatggctcctgaggtgcctgttaagcagccaggtgaaattgccttttaatcagtataggaacagtctctttcctgctgatgctaatgctttttgtaaaaaggtcatgctgtattgaagttcttctttcacggcaaaaccactaatggaactcatctacttactgatgggtggaagctctttgtatgccaaagtcttgttttgtttgtgaagaatctctttccctcaacagtgatgtgctacgttaggtctcaaatcattgttgctttttaatccaaatttatgacaaagattttcagtttgtatgcataatttccttctctggccttaaccatcagtctgtggacttgccaagcaacaaccacaagaacaacaagtctgaggtcaagagacactatttagatctcagaatcatttgttgtcctttatcctttgacaaagttttgcctttctttctttatgagattttttccctaatggtttctcaatctcttgagaagaagaaagttcttgactcttgcagtctttctcattagttgaattataccatcagtacagcttctgatcatgtcgagaaatccaccatgaagaaataaaacatttccgattacatggattacgtttcttggattcttataggcattaaacttcattctaggatacaacctcatgatcttgtcttattctcagaacaagaaatatattactatatacattacaatatatatatattgcagtttccttgctatatatatatatatatgtatgtattatagtaaaccctgtaggcaagcaggaacacttcagaagtctcaatgaatccatcattagctgttagtaatgacaacactgttagaattatttcaataatcacacattgttatggtctgaatgtgcacccccaaatgtaatatgttgaaattttaacacctgagggcatagtattaggaacttgggagtggaactctttttagtgctattatgaataagatgcttgccttttccagcaaatgaggacacagccacaagctgccctctaggaactatgaagttagtcttcaccagacacaaaatctgcttgattttgaatttagcctcccgaactgtggaaaataaatttctgcttttataagccactcaatttatggtatttggttattgtatcccaaacagactaaaacacacattatttacctcctttttggactgtctggggttgttgctttaaacttgcttcagtgcctagaactgctccaagctccctgtcctctggcacacacgtataaataattctgctggaaaccgacatgtttcactcagtcatccaaatgtatttataatgttgtccaaatatatagcacttgttacaatgtttacattttagacatattttgagatatgtgccttaacagagtgctgtgattattattaatatttagtaacttatcttaccagacctaaactcaaagtttttcacaatggcaatgccttatttgggacttatttgggactgaatgtatgaagatcttacattgagtccaaattgatttctctgttagtctcgcaataacattaaagccacagaattatctgctgtatatttcttgtcttgttgtagctgatattctacatattaggacaattaggacattagtaatatctattaaccttagaataaaatgtcatattgaaattgaagaggaatattggaactttgctaagaaagaatgcttttcacacacaatgatatctaaaatggagcctctgttcctggaggtatattttacaaaaattcagtgttactataggaattctgtacacttctttcttagacatttgtattccatcagtgtcagtcctctctgtattttaaactaaataggatttctttttccatctttctgtttgacaagtattgttttgctgaaaatttgctattcatgttcttttaactcattagaaagaatatttagggtctttagtgacaaatgacatggtataaatgaaaagaaaacactgacattgtaattgagaaatactaattaattaggagaatattatttaaaaacattgtttaaatatttctttgttttattattattatactttaagttttaggttacatgtgcacaatgtgcaggttagtacatatgtatacatgtgccatgctggtgtgctgcacccattaactcatcatttagcattaggtatatctcctaatgctaaaccctcccccctcccccaaccccacaacagtccccagagtgtgatgttccccttcctgtgtccatgtgttctcattgttcaattcccatctatgagtgagaatatgtggtgtttggttttttgtccttgtgatagtttactgagaatgatgatttccagtttcatccatgtccctacaaaggacatgaactcatccttttatatggctgcatagtattccatggtgtatatgtgccacattttcttaatccagtctaccattgatggacatttgggttggttccaagtctttgctattgtgaatagtgccgcaataaacatacgtgtgcatgtgtctttatagcagcatgatttatagtcctttgagtacatagccagtaatgggatggctgggtcaaatggtatttctagttctagatccctgatgaattgccacactgacttccacaatggttgaactagtttacagtcccaccaacagtgtaaaagtgttcctatttctccacatcctctccagcctacaatgaactcaaacaaatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaaacattgtttaaatatttctatcacaaattgacagcagtacaatgcacaccaccagcaatgtataattctagatatgagaggtaaaaagataaaacaggtattgcattttctccagaaaacttatcatttagtggaaactggccaataatttcttaggccttaggataattttacctttgattctctagttaatccaaaatatataaaaatattaaccaaaagtatatatttttaaaatgcctacataatctaatgcagtattttttgctctcttcttgaagtgaattaaattccttatcactgaccataaaattgaactccattgatgattcttatttaaaatagttaaaagtgaatgtaaagatcagttgtggttttccttttcttacccttgtttttacacttatatttgcctgtgtcattcacacacttttagaattcaaaacaataactagaaatgtaatcatttgcttttcaaaagcttttcgcatctttccaaagttaatataaagtcttacaaaacttttagctaattcacaaaaaaatcaaacatatatagttgaagcaattttttttttttggtagatttcttcaaaccacagaaatttcagttatggcatggtaggtcttttgaaatgtttcattttttgtatttgaagatgcagagcaaaagtatttccactccaactcccctttaataaaaattgaatgtaacaaaaaaatcaaaatctataggaaaataaccccttcatctatgttaaaactatgagatttccagcccaaataagttataagaaccagtatagagtccaggctcggtggctcacgtctgtaatcccggcactttcggaggctgaggccggaggatcatgagttcaggagatccagaccatcctggctaacatggtgaaaccctgtctctactaaaaatacaaaacaaattagccaggcatggtggtgggtgcctgtagtcccagctactcaggaggctgaggcaggagaatggcccatacctgggaggcggagtttgcagtgagtggagattgcaccactgcactccagcctgggagatagagtgacactccatctcacaaaaaaaaaaaaaaaaaaaaaaaaaaaaaaggaccagtatagaaatactaatacagtaaaaggtggacttatatataaagaaaataaccaacagattttgtctatggcacaaacttcttagaaattttgaggtctttagccttaaagacctaatcaaatatttattactttgaacagtgagctactgggatatgctgggctttgagcctatgtacaaatctaattttagaagtcaggacgtgttgtaagcaatagcaaagaatatgctagatgatcagcttggcaattgttgaacaaacttcattcagcagtgtgaggacgtaattaaagcagttgaccttcaatctattcactctctttattggcaaatggccgaggaataagactagaaggaagatgaactggtttagtctctttgtcagctgaacttgtggtgaaagagactactgatattttctaggatgaagagatcttatctctgaaataccctttgcaggttgctcctgactgaaacaaattcacagattctttcttctcgctcaattttgctgttgattcttcattttacattctttatttcatttattttatgctttagctctagaattttagtttgggttctattttttcaatctgtctgtggaacttctcaattggtttgtgttttgttttttttcaagttttggttgaattgcctatttattctcttgtaactaattactctcctttaaaacaattatttgacatgaaaaaccttgcaaaaatacaaaaatctataaacttcttgacaaagaattcaaaataattattttaaagaatttctgaatttgcagcaaaagtttgctatagagcaacatgaaagcacagaaaagtatgaaactcattgattaaggtaaatatataaaaaatacagaacactctaatagtgtagtagtggtgtgtaaatcagttttattgctagtatgaagcttaaaatccaaaataataataattatagctacaataatttgttaatagatatagaatattaaaaatatataatgtgacaccaaatatataaaatatagtgggctgagtaaaagtatagagttttgaatatgatcaaacctcagtttaaaatagtttgctccaactacaagatagtatgtataagcttcatgctattcggaaagcaaaaacctatagtagatacccaaaagacaaagagaaatcaaagcatgtcactacagaaaatcataaaatctcaaagaacgacagcaagggagaaataaaggaacaaaaatatgttaaaaggctgaaaagcaatgaacaaaatgtcaattgtatgttcttatctatcaataattaccttgaagataaattcattctattctacattcaaaagccagagtggctgaatggattacaaaaggagacccaacaatatactgcctacaagagactcacttcagcttcaaggacacatatggtgtgaatttaggggatgagaaaatttgatattccatgcaaattaaaacaaaaaaacaacatggataactatccttatatcaggcaaaatataccttaagataaaactctaacaggtgataaagatggtcactatataatgataaagggatgagttgattaaagggatgaaacaattataaataaatatgcacttaacattagagcacttgaaaatgtaaagcaaacattaatatctggagggagagatacagagcaatcaataatactacagatataggtaaccttattgacactgttgaaattatcaatactccaattacaacaatggatagatcatttagacagacaatctgtaaggaaaaaaaaattagacttgatctgcactttagaccaaacggacctaacagatgtatgttcacatttcatccacagccggagaacaggtgttcttttcaagctaacaagaaacatcctctaaaatagagcatacttgaagtcacaaaatgtcttaatacatttaagaagattgaaattttatcaagtatctcttttgaccacaatggtatacaactagaaatcaattaacaggaggaaaactggaaaattcaaaaagaagtgaacataacacaattcttaaaaactggtggtttaaaaaggaaataaaaaggaaaataaagaaatcttgatacaaaaatgaaaacacaatacaccaaagcttgtgggatgcagtaagacagtgctaagatgaaaatttgaaatgacaaacacctacattaaaaaaaacacaaatatttcaaataaacaatctatcattaaacctcaaggaactagaaaaaaagaagagcaaactaagcccaaagttaatagaagaaagaaaataagaaagatcaaagcaaaatagagaaatagagagtagaaaagtaatagaaattgaaagacattctgtgttcatcaatgtgagaaattaatattgtcaaaatgctattacacaaagcaatctacagattcaatgtaatccctatcaaaagtccaatggcatttttccagaaacagaaataaatcctaaaatttgtatgaaattacaaaagactataattacccaaactgatcttgagcaagacgaacaaagtaggaggtaccacacttctcactttcaagttatattactaaactacagtaatatatatatatatatatgatactggtatgaaaacagtcacatagaagaatggagcagaatagaaagcctacaccaatatcgtcaaagaatcttcaataacatgcccaaaacacctaatggagacaggatagtctcttcaataaatagcgttggaattattggaggcccacatgcaaaagaatgaaattggagtgttatgctatgcacaggaataaattgaaaattgaaaaggaatttaaacataacatctgaaaccaaagaatccctagaagaaaacaggggaaatcctccataacattgaccttggcatgatattttggctatgaatcccaatgtatagacaagataaacaaaaataaacacatacaactacatcaaactaaaagattgtggcacagtaaataaataaataaataaataaataaataaaaagtcacccatggaatggtagaatgtacttgaaaacaatatatctgataatgcattaatatctaaaacatataagaaactcataatcagaaaaaaagtaacctgattaaaacatgagcaagagacctgaatagacattttttcaaaggaagatttacacacggccaacacatgaatgaagaggtgcacaaaatcactaaacatgagggaaatataaactggaatcaaaatgagatgtcacattacatctttcaaaatagctaatatcaaaaaggcaaaagataaatagtgttgacaagaatgtgtcgaaaagagaacccttatagagttttggtgggaatgtaaattggtacaaccattatggaatacagcatggacactcctcaaataattaaagatgtaccgtatgttacagaaattatacttttaggcataaaagtatatacctgtgggtgtgttggctcacacctgtaatcccagcactttgagaggtgagggaggcagattacctgaggtcaggagttcacgaccagagtcgccaacatggcaaaaccgcatctctactaaaaaacacagaaattagcccagcgtggtggttggcacctgtaatcccagctacttgggaggctgtggcagggagaattgcttgaacttgggagacagaggttgccatgagtcaagattgcatcactgcactccagcatgggcatcagagtgagactccatctcaaaaaaagggtatataccttttatatacttttccttttatatacgatagaaataaaatcactatcttgaagagatatctgcattcctgtgttcattgcagctttattcacaaaaaccaaaatatggaaacaatctaagtgttgacagatgagtaggtatgtaaattatgatatctatcatctatctgtctatttatctatctatctatctacaacggaatattattccgtatttaaaagaatgaaattctgccatttccaacaaaatgaacgagcctagaggatattatgccaagtgaaataagccaggcagagaatgaaaaatactacaggtacaacaatgaaaacttgccattataagatgaataagttatggaggtctaatgcacaacagggtaaaaatagttagtaataatgtatgctttaagttcactgagtgtagatcttaactattaccctttcccaacacatgataactatgtgaagacatgaatatgttaattagcttgattgtgaaagtccttttaaaatatacttgatgggcgcagggtgagaggagagtgagggtcaaaacactacctgctggggactatgctcactagctgggtgatgaaatcatttgtacaccaaaccccagcaacatgcaattacccacgtaacaaacctgcccatgtacctcctgaacctaaaatagaagttgagaaaagaaaaaaaaagatatcaatttcctataaggagctccaggtttgttccaaacagtagcgagacaaacagatcaaggatgaaatatataaaatagtaggcaaaacgtaaacaacatgtgtaaggcaatcgattctatataactcagcaactcctagggttcttatcaaataaaatcactgatgtgtcataacttctaaactaaaaacaacacaaatgcccattcacagtagaatgaataaataaattacttttgcttcccgcgatgaataccacacagcaattaaacaatgaactgctgctacacaaaacatagatgattctcacaaatttcaactgagtgaaacaagtcagactcaaaagattacatacagcaagtttccatttatatgaaattgaggagtagggaaatccatcgtgatagatttcatgataatgatgaccattggtgagtaactggttgagaaagtgcgagagccaggggtgtgggagctggaaatcgtccatatcttgcttgatttgggtggtggtgatagggatatatacacttataaaaattataatgctatatgcttaagatttatgtattttactatttgtaagatatatattagttgaaaaaatgcttcagtgtaaaggaaaccagtaaaaatacgctacctacaattgtagcttttgtttatcaaaaaagcatttgagtagtctattgattggtaattagcaagtttatgttaagcagccttgtcctgaatactttttagtatgtaccattaagcatttgcctttctcaactagggctaattaaaaaaaactcaaaacctcacattgtacacgttgaatatatataattttaatttgtgaattataccaccataaaactaaaaatctaattaagttgagtttgaatacattttagggaaaatacgataaagaaaattaggagcttaagaatatgcatagataaaaaataaacttgatagaaatattatttatatattatatattatgtatatttatatatatttatatataatatataaataataatatatatataaataatactatatgtatttcagaaaatcatataaaaagctgtgctaaaattttccagagagagagtaaatagttctcctgtagtggattaaaatgagattagcattggagtactagcgtaatacaacagatagagtctgaagtcagatctcaaaaatacaatatatttgctaagtaatgcgagacaagctatttaaagtttttggacctaaatatccagtctgtaagtttgttggaaaaaataaatacgctaatagagaacttaacttacagggagtgctaaattattacctgttactggaaaacataatatcagtgacattaaaagcttgagtgttgtagaacaatattttgaaatatcattttttgaagttatatacatatttatattactttaataatttgcacaacataggaaggaaagcttgctttgcacaggcaacatttttgccaaataatctttaaatcatcatgaattctcaattagattaacaataataaaattttattgtagaagactattttttcattaatatagttgtacatgcacatagggtaaatgtaatattttgttacttgcctaagctttataatgatcaaatcaaagtaaccagggtgtccataatctcaagtattatttccatatgttaagaacatttcaagtcctttagctattttggaatatacaatacattgctgtttatatgtagtcaccttactctgctatgaaatattagaacatatgtcttccaagtaattgtatgtttggacctattaacaaacttttctttattcctcccacccagagaaactttccagcctctggtatctatctataattctattctctacctccatgagatcaatatttttagttttcatgtaagaataaggatatgtgatacttgtttttctgtgcctggcttatttcacccaacacaatgacttccagttccatccatcttgctgtaaatgataaaatctcattcttttttatggacaaaaagtattctactgtgtatatatataccatgttgtttttattcattcatccattgatggacagaggttgatttcatatctttgctattgtgaatattgcaataaatatgagagtgtggttatctctttgatatactcatttatttacctttggacaaatagctagtaataaatagcttgcacctctggtctcagctacttgggagactaaagcaaggggatcacttgagcccccgaggttgaggttgcagtgagccatgatcactccactgcattctagcttggttgacagagtgagaacctctccctcctaaaaaaatccttaagaaatgtgttgatgcctggttcccttggtcagaattttcatttgatgtgttgagagtgtagcacagatgttggaatgaacctctcaagctgattttaatgtgcaaccaagtttgagaaccaccaaggaagagtttttatgaattaagattcctatactctatcctagaactaatacaactgaatctctgggaatggagtatcagaatcagatttgaaaaggtttccttagtaattctaaggactgagcagtttggatactcgtttgttagagtaaaatggttaggtacctagtatcaacataggcacccaacctgatattaataactaggaaaataaagggttggcgcctctgtgtttctttgttgaaaaatctgatactattcttagttctatgaaaacaattgaaaatttggttattatcaccttaaaagtacaaaacctatagatattgaaaatgtaattatttttctataggcatagttgaaatgattttgtaaatgttataaatcagtttctttataagcagttcatttacataaattttgttaaactgacatgattcactaattttctaaatataaatggttcagctctcagttatttttaaactaatgacctgtgttatacttactatttttaatgggcttttatgatgtttttaggtttctttggattcccatgtccttcaagtgctttgcaactttgagaagaagaaattgaccacctggactatggaactgtgcataacagctttgaaagtgtatttaaaaattaaatccatacgcctttaaatcagtaaattggaaatatattacatgtattgtaatgactttcctcagatataataaattgttttctttccaatggaatagtgtttgcattttttgtttacctggtttaagatgtgcagcagaacataactagatgattacataatttctttttaaggcaattttataatatattttatttatgattataaaaactgcctttaaaaattcttacatggatatcaatgcagtttcactttttttattgtaatcttttttataattattttatacttgtctggcattgagttttattgggcttttggttttttggaagtagggtatttatcccaatttagaaaatttgtatccttgccataatacagtcttccatttttgtacccccaaatctttcatctgtcagaacatcactcaaaggtgaaaatatttcccacataaaattattctgttcctttaatgaaatgagtttcagctgtatataagtaggaaaacttccttttgttctatttgattcctttttacggatactttcttgaggctgtgattacacctttaccttagaggcactgcccaaaaagactcagctcttctgtaaaaatgctgttatgaatcatagcttcttaacttttacaacatagtgaggtagggaaagtaagaacactagagataggaattagaagcatggagaagtgaaccctggagcttcccaatggtgagataccaaatagttcaagaactagtaaagaagactacggaggaatagctagaagctaaatgaagaaagtatctcaaacaggaaggagtgatctgttaatgtgttaggaaagttgagttcttaggattaagcattgggtagagcaagatttgggaccttgactttgacgaacttggtggatgtcaggagtaagaggaggtattcaagagaatgttggagaggaatttaatatagtgagtattgaggacaacacttaaggagtcttgctttcaaggggatgtgagaaatgggttgttaatggagggtaatgtagtatcaaaaagctgtttattttgagatcgatgatatagtaggtttgtatgctaatgggactgattcagtagacagaaaaagcataatgcaggaaacagagggatattgctgaagccatagacctgggacacaaatagaagggttagttttaaagataggcccacaaacagctcattagtaacagcaggatgaagggcagattatggagttccagatgtttgtagtccagtagataggaggagcatgtcaaatttttgtgatattttctcagtgaaacaggaagcaagctcataaagagggaggaagtcacgaaggagtaaggaaggaaaaggagatgtaaaatgaatagataggagtgtaggaaagtaagcatactcttaggaaatctgtggtttatttaagtggtatcagtcaatgtggttctgtgtttttctccagttgagttcagcataggtgctatcactgaaaaagtacagaattcagtttaactaaaggtgagatttctctaggtgaataaaacagtcagtgatgagatgttgatacatttaagagaatgattataaaagagggatgtggaaagtagtctgggttaagtagtgaagtgagaaaataaagaaggttgagacagtggaaaatggaatgatcaattgtagattgcagtgtggttgaagatgcaatggacttcttgaggtgggaactagaaatttgggggatataaataagagaggggtgactgaaattgaaaatatgagagtataatagtatacaatattactaagtatggtatactaagtatagtagaatagtactaagtatagtagaatagtactaagtatatagtacttagtgagtataagttttaggatgtgaagaggggagtagcgtagaggcaaggtgatggaagcagatgagttcaagaaaatgagaacctaggagattgaaaccattatctaaatgaattctgaaatctcaagaagaactgtgctgagtgcttgtagtcattattttgtctttactactctgtgagaagacagcacttccttttgtgagtaatggaaagttctttaatatgtcaactgtaagatactttattacatttaattatctttagtaatgcatagtaataactaatgacctcagtaggattattcagtagatatgtgagctaaccccctgtgtcagacacctaagaggaacaactgatgtttttcaagacgaatagagggttctcatcccagggttttaagctgcaaaatatcccaccctatattttctgaaaacaaacgttatatagagtgtccacataaaagctaacaggaaatattacacacacacacacacacacacacacacacacacacagcattgaaaatgcatcaggaaagatataccctgtacccaacatgcacaaggtctaagcaatgaagaaaatctaggaaatcaaataagaccagaacatctatgactaatatataaatacttgaggcagttatatccatttaaaaggtgtcaattagacatgaaagaaaaaggccaggtgcagtggctcatgcttgtaatcccagcactttgggaggccaacgcaggcggatcaacgtgaggtcaggggtttgagaccagcttggccaacaaggtgagaccccgtctctactaaaaatacaaaaaaaattgctggttatggttgcacgtgcctgtggtcccatctacttaggaggctgaggtaggagaatcatctgaacccagaggtagagattgcagtgagctgagattgcgccattgcactccagcttgggtgatggagtaagattaaaatatatatatatacatttttacataagaaattttattttaatttttttgtaaattagaaaatagcaattaatatggtatttatataccagaatctttgaatatctaaaatttaagaagatgtgagcaatttcatgaaacttttcaaagcttagaaaaaggtagctatgtaaaataacaatgtatgttgtttatgggaacattagatgaagtaagtcatgaaaacatgcatagaaatgatcatataaacttgcaagaaattgaatgtcttgctatcaaaggaaaggatggaggtgtaagagactgaggtagaatgtgagaagctctgtatatattgtattttccttaaaaatatatatttaaactcgcatttcttgtttttcaaatgttcactctaatgaaaattcttttatttttcctgttacagtttttatttctgatctcatatatgcagtgtactgttgttcagaaatatcattgatcctccctgcaaatgaaatactctcatcctgttgaatttgagaatgtacacatgatttgctttggctttgaaatgtgagcagaaagaatgttttactttggggagttcccaattgctaaaccatgtgtcaaaatgaagtttttgtgacattacaaatggactaataagagtgcctttgttgatcctagttgaacatgagaaacttggttattgtaagccactgaaaaattttagtttcttttattactgcagaatagcctattctgtcctgattgatacagccacaacatttccttaagctctttgattttcatattgccattaggatgtagaatgccaagagaaggataaatcataggatcagagaatgttagcagtgaacgagactattggaatacattttttcaatggtttccagactttgggttctaagtaatcagtaatatttcgaaaaagtagtaaaagatatttcaatataaaaaataatgacatttaactttgaaaaaaaaaacctatcattgctaggcataatgggtctagcttgtaatcccaacaacttgggaggctgaggagggaggatcacttaaagtccaggagtttgaggctgcagtgaaccatgattgcatctccacactccagcctgggtgacatagggccacctcaacaacaaccaccaccaaagctatcattaatacattgttcctctgtctctcttcccatcctccttaccacttagtcttaaatctaatcttattaaacaatatctaaggaaaagataagaaaaatgatggttgcatctatactgaacatgtgttgacttttttcttgtcactattttctaaacaacacagtatcacaacttttgacatagcatttatgttgcattagttattataagtaatctgagatgatgtaaaggttatatgcaaatattatattttatataaaggacttgagtaattattactttaagtatccatggtggttcctggaacaaattcctcatggatatggagggaggaggaatcactgtaattaaacaaatcatcactttaaaacttaaaaccttttgcatgttgaatacagtcatgcaccacataaatgatggtggtcccattaagtttattatgccatatttttatcggaagtttcctatgtttaagtgtatttagatacacaagtacactgtgttacagttgcctatagtattcagtaaaataacatgctttacaggtttgtagtctaggagaaataggctaagccatctaggttaatgaagtccattctatgacatttgcacagtggcttaattacctaagggctttctcttcagaacctactcttgtcattaagcaatgcatgactgtagttggacaaaaaataataatgcaggcatacctttggcactgtcctaattcttaccagcatccatgattgcttaaatttgcactggaaagacttcaaaaaacagtgatatattaggacaatatatttccagtacatgacaaatgataacaacataagaactcgaaacactcaataaaaaacaaaaaataaagcaaaactagatgggaaaaggaagaagcaaatttcaagagaaaactcaaaaggccaaaaaatgtgaaatgatgttcagccttgctagtaattgggaaaaacacaaatcattttttttttttttttttttgagatggagtctccctctgtcacccacgctggagtgcattggcgtgatctgggctcactgccagctccacctaccaccttcaggccgccattcccctgcctcaggctccagagtagctgggactacaggggcccaccaccatgcctggctagttttttgtgtttttagtagagacagggtttcaccatgttagccaggatggtctccgtctcctgacctcgtgatctgcccgcctcagcttccgaaagtgctgggattacaggagtgagacacgtgcccgacccaaatcatttttaatctattagtcaaaaattagagctatgataatattaatttttggtgggagtgtggcaaaaggtactataatatactgctactagagagtaaaaattgataaattttgtaagggcaattttgcacaatatgaaaatataaaaatatgcttcatgtttaccatacatttatctagcatacagaattacccatgtgtaaacatgtatacagatgttcattataacacttcttataaaaacaaaatatttggaaataaatgttcatattaataaggcgcataccgtatgatcttagtccagttagaatattctgttttatttcaatcctttaaaagactcaacttctgactctatatagacgattaaaaaaagaatgtgttctccctttgtgcatttggtcaggtaaattaaaaaatacaccacatgctagccgcaccaaactggaataagcctttggaaagaagttgtccttgaagcttgtatctgacattgtagcaggacgagcctcagacaaaacctctcagacactgagttgtagaaggaagggctttattcagctgggagcatcggccagctactgtctcaaaatctgagctcccggagtgcacaatttctgtcctttttaagggctcacaacactaaagatttcacatgaaagggtcgtgattgatttgagcaagcaagggatacgtgacaaggactacattcactgctggtcagggagaaacagaacagggcagggagtttcacagagttcttttatacaatgtctggaatctgtgaataatatcagcttctaaatcataagttgatttttagctactgggtttaggccaatcaggcccaggcctggtttcaggcctggcgctgggctgcatgtctttggttgtacttcctggttgtttttactgaatagaaaacaatataaaacaaggagagggtctttgtctcctctcaatatcagcactggattgtagaatgtgttgctgattttgaccttgtattcaagttaactgttgcccttggtatctgtacatatctttgatttcagtctttactacacgtggcttggtcacttcatggctaaaaacatgcttgtggaagaccagtctggctcggtgagtctgtgcggccagcagtctctgatctgtacagggtattaatgtgtcagggctgagtgttctgggatttgtctagaggctggtaagggcttctggaccacttgtttctgtcctgtcagtctgtcagggttggaaagtccaagccataggacccagtttcctttcttagcttacgttatctaccagagcaccgtgggctgttacttaccttgagttggaaggggttcgcatttatacctgtaaaagtattcatccttttaatttatgtaaagtttttttgtatgccattctggatctttaaagagatgacaacaaattttggttttctactgttatgtgagaacattaggccccagcaacaggtcactgtttaaggaaaaataaaagtgctgccagaacctaagaaaaacattaatatctaaaaggtcatttagatgatttccatgagagactttttgatgttctttacctgttaggattattattgataatccttttcagattatgaataaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtgggtatgattcatagtatcaattgcggaattcactgtgcttgtaggaaatagtattctgatcttatctgtgaagcttgggcaacattttacttcacaggtaagtattctaagtaaaagagatttctgagggaaaatctatgtagtattcttggcaactttatattttgtttctgagataatctttcttcaccaagagccctccaatgtgctgttaatattttcaagagatagctgcctataccaagattcaagaatcttttatactattgattagtttctagaacattcaatgatacacagtaagacagaatttggtacttatgaagactgtttaatttgtaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggtaagtgaattctagtttcctttaaaaataacagacaggaaaatggtttctctctcttctttcttgctccttttcagcagaaaattttccgtattttatttttttaattttacttcataatttaaaactcaaaattaactgtttatttatgttcaacttttgtgaatatttgtgtgtgtgctatctactaaagaggtaagttaaagtttaaatcagaatttgcttctaaagcaaaacatcaaattttaacccttataactgttcgtatttcccggaaacaatttactggttaggaagtataattccagttacaatgtttgctatcatttttaggtgacttgtgtctccatccgtaattcttgggtttttcatggtgaatagctagcttctctatttaatgaggagcataaattgagattaatagctaccttgtttgtcttcaaaagcttcatagagagtacaggctttctcctggtgacccactgaaatttccaaaacaataacctttccactctcatctgagttttgtcttcccaaagtgggctttttgcatttcctcctatttatggtagtttctggtctctcaatttatcattcctataaatatttgaccaagtgtctagaaggcatgtaggtgtttagttcacattactttcctttcacagttgatttttgatcttgtaggaaaataattataagatatcatgaaatattttggagttttattaacatactataaacttgcatcaataatgctttaaatttctacctctctgtaagtcacactgaagtagaaactttgttttctaggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaactacaatgatgctactcaggtaatttttttacgagagtgatctgaataaaagagtaatatatgccttttcttgtagacatgtagctaattgaatttcatttaaaataggaatttagatctcttagggacagaagttaacaagtttgactactttaagaaactcaaatccatatttaagaactttcaaatattgatttaagatttttaatcaatacacatttgcccacttctaagaagttcccaattaaaaatctcatcgactttatttcctaaattctctattttctattagaaaatatttcaaagatacatctgtagtagaatgtgagcatccccagtgcccaatgcaaggaagtcactatagaatatctcttgaggaatcatggaataaatgaataatccaatggattctcaggagaaaaatgaggttttatgaatcaatcataacatttttacctcaacaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacttatatgcctataaaatatcatcttattcgttagaaaattaatggaagatttaattaaaaatgcaatttctgtaggataaggaatgagacatttacataaaacagtgttctttaacctcctcttcttcacatacagcatatctaattctttatcacaacatgttttatggaggtacacagaatgtaggatactgataatagttatgtctttactttctttggataatgaaacaagttaatatttatcaaggaatttcagtcgatactaaatgttttattagtgtgagctcttattattatcattgatgtagaagactaaaaattaggtaagtattttcacaggacaacaggtatctttgacattatgcttctttcaatattgtagcctatactttatcaaataaaagaatataagaatattacctgttgagataataggaataagaaaaccattttgcacatttcgtgtaacaaacaggaccaggcatggtggctcgtgcatgtaatctcagcactttgggaggctgcggcagggggattgcttgaggccaggagtttgggaccatcctggacgacatagcaagaccctgtctctaaaaaacaaaacaaaacaagacaaaaagaaataataaatagcttaatttattaataaataacaaatagcataaagctatttttatataatattaacttattggttaaaatgctttaaagtccttacacaaaatgttattgtttcctaaatttctactaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttccctgaagtatttcatggatctattagtcatactacctcagtgtgacttatcttctggaacattcttattcagacaactatcaaagagtcaattgtgaatgataagtattctagtgccctaaactctaatcaatcatcttttgtatttagagtgtctgtcacaaggcaatatgtctaggaacgctaaacataccctaggagttttcatctaagtacgagatgaatatactggatttgactgatgtttgcatataatcttttaaagccaggttattattaaaatgatcctatcatttatgaagtatgtacaaagtttccatcctgtagaatttacatgtattatatgaattaaaaatataaaaaatatttatattataacaatacagtattgaagccttattttaatctagtttgattaaactagattggtctagtttgattaaactagattaaacttcttggtctaggcacatgaatattgttgtggggaagagaattctgtataatgtgatatggatattgatccttctggagtgcctctaaatgataatgtgctgaaacctctgaaaggaccttttttaataacaaaaatcttatatttgtaatatgaatgtaagtattccatacatgtatatacaaatatggaccatacatgtagattacacatgtgtgtgtgtttgatgtgtgtgtatatatatgtgtgtgtgtgtttgtgtgtgtatatatatatatatctcttacaggaaaagcatttaattagagaaagaatttaatcttcagatgccatgccttacagagagagatgcacagttaagttactctcaaactgttgtgaaatgatacatcaacgtatatcttatttttcaaaaataggaactggggagaaggttggggtttcgtaccttctgacagagcgcttgtctttgtggataaccatgacaatcaacgaggacatggggctggaggagcctctattcttaccttctgggatgctaggtagaaaaccaagttctctatttttttaacacgtcttttaatgatggcaagaatattctgacatcctatgaaaatataattatgtaacttccaggctgtacaaaatggcagttggatttatgcttgctcatccttacggatttacacgagtaatgtcaagctaccgttggccaagacagtttcaaaatggaaacgtaagttttggagttgttcaatatatccttttctgaagaaaaaggaagcaatcttattctaacttaacatgacaactattaattatatatttattcaacaaatatttaattgattgtaaactggatacagggctgtgattttagtaatgtaggttatattaaaggagtaaaatttatattctccattgacaaagagtatgcaagctgtttcagagatatgacaaacatccccttagcccgcagggaaacaaaaaacaaaaaacagaaaaacactcaaaactaagagctagacacagggattaaaatatatacttcgaataagtacctacctcagggctgataggaagattatacatgccaacacttttagagaacttaaaacatcatctgcccgtagtgagaacaatataaatgtttgttaaatacttttaaaaagttatatggaatagaaagaaatgaatcaattgagctgagttaaatagggaaagtatcatataagaggaaggaaatgatatgtactaaagaatagaaatttagagagtattccaagaaaggtaagaatgagaaaaatatttgggagtatggtaaagacattaatctgatgagaagtttcaaaaaggaacagagaaattacagtgtaaagatatttggaaagctagtagaaggttttcttttaaactaaagggttcagaaacagcatcagagacttcagaactaaagcagaaattcctccttcctatgagtcacacggatatctagctagctttttttagattcctttcagtttgagaagtccgcactttgtatagcaatttattctattgttaaacagctttaatatttagaaggtgtacttttatattgagccaacttcttttaatttctactaattggtcttatttctgatgttaggagtcatagagtatttttattttttctattactataacatttccactttgccaggactgctgcatgctaaaaactcttagttttgttcacttttcaccatatgacatgattctaaggtcaacactgaaaaacttcctaagattcctctggattttttaatgaagattttttaaagtgccaatcagaaaaccataatatgaaaaatgtggtcaatttataaataatgttcagatgtattgttttgtacatttatctaaaaagaagcatgaatgattctaatatttattcagcacatgtcacattcaaggcattttcacatatattacttaatttttatagcaaaaaaaccaatattcccattttacaaatgaagaaactgagacacagagatattaagtgtattgattaaattttctcaggtactagtaatagagcctatgttttaatcctggtgtttctagtactaatgcccttcccatttcaatgacattgcatggcttaccacgatgttaagaagctcttgcaggccaggtgcagtggctcacacctgtaatcccagcacctagtgaggcgaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgatcatgccactgtactccagcctgggtgacagagcaaagaagcctttgcagttctttggaatgaaaaggagaggataaaaatttgttaccttgtttgaaatatgccagaagaaaaccagaggatagagagatgatgaagacccagtaaagggctataaacattaatgaaggcattggattctagataaagtcactgaatgcagagacacaagtaacaggattggttgggtttggtgtaaaggagaaggaagaggtaaatacatgcatagtaaaatttggctttttcccccctacttaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccactgcattttatttaaaacagttgaagtttaagaatatcaacgttttatatggtattgtgtttttaggaacatggttattttccgcaatgtagtggatggccagccttttacaaattggtatgataatgggagcaaccaagtggcttttgggagaggaaacagaggattcattgttttcaacaatgatgactggtaagtaaatatcaattaaaaataatattttgtaccagtatgttcttggtttattcttttttttctctgttcattgacttttatcatatctgaaaaatcatgtagtcagtggagcaagaagacaatagagatcaaaattgggcagaagcaaaaggatgatggctgttactccttcgttctttttttttcataagtgctttctgttgtaagcagaatcctttctgtgcacccttgcagtatcatatgcatatatatgatgcacatgcatatgctcacctacacatgccacaaaatcaatatataaaatcacaatcaatataaggattgtgaaatcattaaaaaaaagtgtcttataatcctgcttttttaaccatggagaaatgctgcctaggtactaaaatatctttatttctaactctttttctcaatgactgctctacgtagttttttggtacactttcttcacttctctgtctccttgtgacaaataacatttttaaagcacatgtatgaataatatgtatcttgtggttactgttttgcttcaggagatttgagttttatttttgaaacttctcattattggcctttcatctgtgattcttatatgctttacctgaagcataaatgattatctaagatatagctcagaagaccttggtgtaaacagttgaattgtccctgtccaagaccaactgacactcatacttagctcactctagtataaattatatttcactgatgaaaagtaaataaatacatcaatatacaagtcaagttgatctctttcctgccaaaaaagcccatgtctagttttttaatttctttcttttgtagatgaaaataccaaaataagtttttgtgaaaaagctttatatttcaaactatcacttcttcatagaaatgctagattatttttatgtgcatcccaaattcgttttgatctcatgggagaagaaggaggttaaaaaataataccctttaaatttttaagagtaattggtattaatttcagttgagaacaaatttgattttaccaaggtagaacttttatcaaagtgtgaccgttcctgccaatcttcagtgatattcttcaactttgatgttttggtaatattttcactactaaccaggaaattgctaggttttctgtaaggttacttttggtcctagaaagctatttccacctactagagaggcatatgggttttcttcttaataagacttcactgcttaggtttgtttctacaacataaagttatgctgtttatttgtgttagtctgtattcttgattttcattgtattgaagatcaaccttaaattttattttacaggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctcaaaacaatagccaagtgtgtttcttttcttacatgtacagcagtacttatatttcattaatttttactaaaagctctaattagtaattagaggttcaaaaaagttgatagtgtgaaacacaattccaggttacacagaagttatttattttggcaaaaggatgtctcagaaattttaaaactaggcaacaacctttactcattaagagggaagacttagctttccaaacagtctgtctcctgtctactcttttctctccttggcagtctaccaacaaggcaaaccaaatatttcattattcttctctattacatgaaaaatctgtacaagggaaagaaaaccaaattttacccttacattggtttcaaaacattcctttttccataggcaacgtttacatttttatgcctttttataatcttttatgacaaacacattttactgtttttacacacattttacacactttgcatgtaaatttatttttagttgtcttatttacatgttttaatggtaaatcttaactttgccattttagttaaaatggtaactttaatgtaaaacctggtaagttttttcaattatgtactagatgcagataaagtctgactttttccatcctagttaggggcatggttaatttcatatgtccccaggccttatcaagttgtaaagtaggcagtatacaaccttgaaacatttagcaaacctggtatctaacttatatgatttaaacctcctatttacgtgttgatgatatttgcattttccaatttgatctttaaaacaatttttatttcttagagatgaaagtcacataaactaaaaggcattgcagttttaactttcctctaaaatgtttgatttaagtgcatatttttatttcaggcaatcagttatagctcgttacagacatcacacacaacacatatatcattacacagacaaacagaagcagatccagtagttctaagatttcttcctgtcccacttcctaattgaattattggcttcccagtagagccctttaagagcagggatagaaaaaccatgaagtttctagggcctaatcaacttgtatagctgtaagacaaaagcagattttgagtgggatctatcagcctctaaattctgggattccatcaggaaaacagaggtttctcccaaaatggaatccactgtgccttttctgtttttcccaaaaagtttcaggccaccagacattaccttgggtgcatcaagagtggaaagacagagcggaggacagtaattcagccaacagaaaaattcttttcaagaaaaacacaatccaagaagagaaaaacatacgggccttttaaatatacctataacttgaatatccacttttaatcaagctgagcactctttcagaaattcctttgaaatcttctgttacctgactttagctaaatcaagcaggtaatatttctggcttttgaactttactaaaagtaacatcacaggtgaaaacaacaactctcaatcaggttataagttaactgtgagtattcaagatattttataagtggtggtaagcagcttttactagatctagaaactttaaaggcaatttagagaaaggaagatttcagaaaggaaattagagttgttcatggaggaggaagagatgattaaaggtcatacagctattaaattgaaagtattcatcacccaagctaggattgaacctgggccaccattgtaaaatggcaatggctaaaaaagtcctgccacaaggttacaggttatgctcaagacataaaacaagatagaggcatgcagcaaagtttgttacttaccagtttatgtgggtgacttgaatagtgagcttatggagtcccaggcctggattccattccaacgtattccaacccgttccaagatgggttgttacccatgcagaaaacggggggaatataaggtgtcccttagtctcctttctccttttgaagtgacccaggatgaagcaaaagattacaggggtgtccctgttctcctctttcctcccatctcctttgggtcccggtaaccatcataggtgctgtccatggatgaaagcatgaattgcacccatggatgtggaggtgctagctggcaggagtagtcatttttaccagcacaatgcctcctcacactgctcttctgggttcctaggcctcccaggagattctacagtagataaagttgggtgagacactttaatagagggagtgttttaaccctattcctgcctcctctagttatggacctggaaaagcagtgcattcccagaaaattttatccattgacatttaaatataaaatcccctttctgtttaaatgccaatgtggttggaagcagaacaggtgtctcaaaagaacatatagatttaatggctgtcctccttctgatggaaacagcactaaggctagaatttgtctctcaagggtggcttcctcccaactgttgaatgcggagtttttttccttagaaatggggcatagggtctgcttgctgttagaggaacacaaaagagggagaaatctgggcattagaattttttggcgaacggccaccaagaatttttacggagaaaaatagcctatctcatgaggtggtgctgtagggtctgaaaagttatgtaaaatctgtgactctaaattttttccaggaagaagttagaaagagaggtttggggtttaacaggctgtcactgtatatgcctcccagcagtagaaaattaacttgtctcattaataaactgttcaaattcattcagcagtgctgagcttttacatgaaggaaaagcaactgaaatggagagggatgagggtattcacttggggtgaaatatcttctcatagagtgccatgaatgactgctattgcgggacaagaagcacttactaggtgaaggtttagactgaaatcttgaaatcccctggtattttgtgtgtctgattacctttccaaaggaataaaatcagatatgtatccatctcagtgagcagaggggtgactttgagtagaatgggaggaaggtttgttctaagtagtttcccgcttgcattttccccagtgatttcaggggcccagtatattttcctttcacacatctgacaagggattaataaccagaatatctacggagctcaaacaactctagagggaaaaaaaatctaataattgcatcaaaaagtgagcaaaagatttgaatagacatttctcaaaagcagacagacatatggtaaacaagcatatgaaaatgtgctcaacatcattgatcagagaaatacaaataaaaactacaatgagatattatctcaccccagttaaaatggcttttatttaaaaaacagacaataacaaatgctggtgaggaggtggagaaaagggaaccatcatacactttttgtggttatgtaaattagtacagctgctatggaaaacaatttggaggttcatcaaaaaactaaaaatagagctatgatgtgatccaggaatcccacagctaggtatatacccaaaagtaagaaaatcagtatattgaaatgataactgcactcccatgtttattccagccctgttcacaatagctaagacttggaaactacctaaatgtccatcaacatatgaatggataaagaagatgtggtacatatatacaatagagtactattcagccatggaaaaatgagatcctgtcatttgcaacaacatagatggaactgaactgtacattattatgtgacgtaaaataaaccggcccagaaagacaaacatcacatgttctcacttatttgtgggagcagcaattccaaacaatggaactcacggtcatagagagtagaaagatggttactagaggctgagaagggtggatgggaagcaagtgtgaatgttcaatgagtacaaaaaacagaagaatgaataagacctaatatttgacagcacaacagggtgactatcgtcaataacaacttaattgtacaatttaaaataactaaaagaatataattagattgtttgtaacataaaggtaaatgctcgtggtgatggataacccatttaccctgatgctattactacacattatctgcctgtatcaaaatatgacatatgccctataagtatatacacctcctaggtaccaacaacaattaaaaatttaaaaaagtgtatccttcccagtgaaccgaaatattttacattgatcatttttacattatcatagtgtgttggaataatcatagctttggaaagaaaaaaaataaatgtaaactttcaaagatggcaggagatatagatctctctttctttagtggatttaaatatgcaatttgttatcaacattgcactgacaatttttaacacaggccatattctggaaatgatatgattataggagttataggaaaaagcattttttcatactgtgattatctaggctatgaggaaaagagatatttcctctatgatgtctaatttagcataattattctttttaaactatatttagatttaattaagagatacacaaacaaattacttttagtagtaagaagagtttttaaaatgttttgtgtaagatgactatgtagtaaagaaggttacaaacctgctttttaacttagaaaaataatctcaccttcttgccccatggaaaattgaaatgttatgtggaacccaatgtacaaaaactctcagtgaggatttctgtcttaagtttcaacggattgaggtgagatcagtgcctgttccacctttttcctccctgtcctaggtgacttgataacatttatacagccataaaattttgcttttaaattcaagtatagaaaataaactttaaaatgtgatatttttatatattttaccttaataatttatatgggaaatatttttgaaaggttaaaaaattaaaatttttaaaagagtatagtgaaataatctaatcacatgtggaaattgtgttactatttccccaagcattttttgtacatgtaattgaaaatgagttgaatgtaactcataagtagtataaaagtgtttaatatttaattttctgctgcagtaatgtgacataacaaccttaaattcttggtactttaaacaagatattttttttctcccaaatttctaggttatttaagggcagttctgcttcatattgcagtttgcctgggctttactccaggctgtgtgttggagttaggtctaatctattgtatccctacacatcccacttagaaaagctaacaaatttcctttggacttcagtcagttcgattgtatttgtcattcaaaagccaaatcatttatcctaacaccaacggcttatttatttatttatttgtttgtttatttatttatgttttagaaggagtttttctcttgttgcccaggctgaggtgcaatggcgcgatcctggctcaccgcaatgtccccttcccgggtcaagggattgtcctgactcagcgtcctgagtagctgggattacaggcatgcaccaccatgcccagttaattttgtatttttagtagagatggggtttcttcgtgtggatcattctgttctagaactcccgacctcagttgatccgccagcctcaggctcccaaagtgctgggattacaggcgtaagccaccgctcccagcctaaccgattgcttcttttgttctgtagtcttttgccaaaactgttattctctggactcactttcaccttctctcacacatacatgtccctcgtgtccctttgtgtctccagggtcttctatttccacgtaatcttaatttttcatcacatcctggactcatgagtaattaatctgttattctccctgaaagtgcagccttgttgaatagaatgtgttctttaaacagcagctttgtttctcgagtgaggtattaacttccagatttaggtgaaaatgagttccaagttttatgtttcattgtgtgtctaagactgacaccgtttattaccgtggcacttacagcttgctttcaatgcctccaaattctctatctgaaaggctgggtaccatatctcatgtctgaacatagtcctcagaatcatgcagtaccagctatgttccttctgtatattatggcttccgaggtgcctgttaagcagccaggtgaaattgccttttaatcaatataggaaccagtctctttcctggtgatgctaatgctttttataaaaaggccatgctgtattgaagttcttctttcaggacaaaaccactaatggaactcatctacctactgatgggtggaagctcttggtatgccaaagtcttgttttgtttgtgaagaatctctttccctcaacagtgatgtgctacgttaggtctcaaatcattgttgcgttttaatccaaatttatgacaaagattttcagtttgtatgcataatttccttctctggccttaaccatcagtctgtggacttgccaagcaacaacaacaacaagaacaacaagtctgaggtcaagagacactatttagatctcagaatcatttgttgtcatttatcctttgataaagttttgcctttctttctttatgagtatatttcctctcatggtttcccaatctcttgagaaaaagaaagttcttgcctcttgcagtctttctcattagttgaattataccagcagttcagcttctgatcctgtcgagaaatccaccatgaagaaataaaacatttctgattacatggattacgtttcctggattcttataggcattaaacttagttctaggatacaaccgcatgatcttctcttattctcagaacaagaaatatattactatatacattacagtttgtatatattgcagtttatatagagtatatgtatatgtactgtatatatatatgtacacatatatataacagtaaaccctgtaggcaagcaggaaaacttcagaattctcaatgaatccatcattagctgttagtaatgacaacactattagaagtatttcaataatcaaacattgttgtggtctgtatgtgcacccccaaaagtaatatcttgaaattctaacacctgagggcatagtatttggaacttgggagtggaattcttttttgtgctattatgaataagatgcttgcctcttccatcaaatgaggacacagccacaagttaccctctaggagctaggaagttagtcttcaccagacacaaaatctgcttgattttgaatttagtctcctgaactgtggaaaataaatttctgcttttataagccactcagtttatgctatttggttatagtggcccaaagagagtaaaaagacacattatttacctcctttgtggactctctggagttgttgctttaaacttgctttagtgcctaacactgctccaactccctgtcctttagcacacacggataaataattctgctgggaactgacatgtttcactcaggcatccaaatgtatttattatgttgtcaaaatatatagcacttgttacaatgtttccatgttagacatattttgagatatatgccttaacactgtgctgtgattattattaatatctagtaactaatcttaccatatctaaactcaaagttttcacgataacactgccttattagggactgaattttttaaagtatgaagatcttacatcaagtccaaattgattcatctgatagtctcgcagtaaaatcaacgccacagaattatctattctgtttcttgtcttgttgtagctgatattctgtgattggacatattgctaatatctattaaccttagcataaaatgtcatattgaaattgaagaggaatattggaacttggctaagaaagattgcttttcagacacagtgagaactaaaatggaccctctgttcctggaggtatattttacaaaaattgggtgctattataggaattctgtacaattctatcttatgcacttgtgttccatcagtgtcaatcctctctgtattttaaattgactatgatttctttttccatctttctgtttgtcaagtattcttttgctgaaaatttgttattcatgttccaacagaaaatagattttttttcttttaactcattggaaagaatatttagagtctttagtgacaaatgacatggtataaatgaaaagaaaatactgacattgtacttgagaaatactaattaattgggagaatattaattaaaagacattgtttaaatatttctatcacaaattgacagcagaacaatacacaccaccagcaaggtataatagtagatatgagaggtaaaatgattaattagatattgcattttctccagaaaacttattatttagtggaaactggccaataatttcttaggccttaggataattttacctttgattctctagttaatcaaaaatatataaaaatattaaccaaaagtatatatttttaaaatacctacataatctaatgcagtatgtttcgctctcttcttgaagtgaattaaattccttatcactgaccataaaatttaactacatagatgattcttgtttaaaatagttaaaagtgaacgtaaagatcagttttggttttccttttcttacccccgttttttacacttatatttgcctgtgtcattcatatacttttagaatccaaaacaataattaaaaacataatcatttggttttcaaaagctttttgcatctctagaaagttaatatagagtcttataaaacttttagctaattcaaaaacaaatcacacatatataattgaagcaaactttgtttggtagacttcttcgaaccacagaaatttcagttatggcatggtaggtcttttgaaatgtttcattttttatatttggagatgcacaacaaaagtctttccactccaactcccctttaataaaaacagaatgtaacaaaaatatcaaaatctgtaggaaaataacccattcgtctatgttaaagctatgagatttccagcccaaataaattataagaaccagtatagaggccgggcgcgatggctcacacttgtaatcccaacacttttgggggctgaggcaggcggatcaagagttcaggagatcaggaccatcccagctaacacggtgaaaccccatctctactaaatatacaaaaaaagtaattagccaggcacagtggcgggtgcctgtagtcccactactcaggaggctgaggcaggagaatggcctcatcctgggaggtggagtttgcagtgagccgagatcacaccactgcactccagcctgggagatagagtgacactctgtctccaaaaaaaaaaaaaaaaaaagcatgtagaaatactaatacagtgaaatctggactgatatataaagaaaataaccaacagattttgtctatggcacaaaattcttagaaattttgagatctttagccttatagacctaacaaaatatttattagtttgaacagtgaggtactgggatatgctgggctttgaggctatacgcaaatctaattttagaagtcaggaactgttgtaagcaatagcaaagaatatgtttgatgatcagcttggcaattgttgaacaagcttcattcagcactgtgaggatgtaattaaagcagttgccctgcaatctattcactctcttcactggcgaatggcccaggcataagactagaaggaagatgaactggtttagtctctttgtcagctgaaattttggtgaaagagactactgatatttttctaggatgaagggatcttatctctgaaataccctttgcaggttattcctggctgaaacaaatgcacagatcctttcttcttgatcaattttgctgtcgattctcattttacattctttatttcatttattttattctttagctccagaatttttgtttgggttccattttttccatctctctgttgaacttctcatttggtttgtgttttgtttttttcaagttttagttgaattgcctatttgtcctcttgtaactcattactttcctttaaaacaattatttgacaggaaaaactgcacaaaaatagaaaaatctataaatcacatgacgaagaattcaaaataattattttaaagaatttctgaatttgcagcaaaagtttgctatagagcaacatgaaagcacagaaaagtatgaaactcattgattaaggtaaatatataaaaaatgcagaacatgctaatagtataatagtggtgtgtaaatctcttttattgctagtatgaaggttaaaataccaaagtaataataattatagctacaataatttgttaatagatacagaatattaaaaatatataatgtgacatcaaatatataaaatatggtgggctgagtaaaagtatagggttttgaatatgatcaaagttatcagtttaaaagagtttgctccaattacaagatagtatatataagcatcatgctaatcaaaaagacaaaacctatggtagatacccaaaagataaagagaaatcaaaccatgtcagtacagaaaatcatgaaatctcaaagaaagacagcaagggagaaataaagaaactaataatatgttaaaaagccaaaaaacaatgaacaaagtggcaattgtatgttcttacctatcaataattaccttgaaggtaaattcattctattctacattcaaaacccagaatggctgaatggattacaaaagaagacccatcaatatgctgcctacaagagactcacttcagcttcaaggacacatatggagtgaatgtaggggatgagaaaatttgatattccatgcaaattaaaaccagaaaacagcatggatagctatccttatatcaggcaaaatatactttaagatacaactgtagcaagtgataaagatggtcattaaataatgaaaaagtggtgagttgattaaagggatgaaacaattataaataaatatgcacttaacattgaagcacctgaaaatataaagcaaacattaatatctggagggacagatacacagcaatcaataatattagggaaataggtaaccttattgatactgttgcaattatcaatactccaattgcaacaatggatagatcatttagatagacaatctataaggaaaaaaaacattagacttgatctgcactttagaccaaacggacctaacagatgtatgttcacatttcatctacagctggagaacaggtgttcttctcaagctaacaagaaacatcctccaaaatagagcatatttgaaattacaaaatgtcttaatacatttaagaagattgaagttgtatcaagtatcttttttaaccacaatggtatataactagaaatcagcaacaggaggaaaactggaaaattcaaaaataagtgaacataatgcaatccttaacaaaaagtgttttaaaaaggaaatgaaaaggaaaataaaaaatcttgatacaaaaatgaaaacacaatactccaaaacttgtggcatgcagtaagaccgtgctaagaagaaaatttgtatgacaaacacctacattaaagaaaaaacatctcaaataatctatcattaaacctcaaggaactagataaaaagaagagcaaactaagcccaaagctaatacaagaaagcaaagaaatatcaaagcaaaataaagaaatagacagtagaaaaataatagaaattgaaagactttctgtgttcatcaatgggagaaatcaatactgtcaaaatgctattggacaaaacaatctacagataaatgtaatccctatcaaatgtccagcggcatttttcacagaaacagaaataaatactaaaatttgtatgaaattacaaaagactataagtacctaaagtgatcttgtgcaagaagaacaaacaggaggtaccacacttctcactttcaagttatattacaaaactacagcaaattttatatatactgacatgaaaacagtgacatagaagaatggaacagaatagaaagcctagaaataaacctacaccaagacggtcaaaaaatcttcaataacatgcccaaaatacctaatggagacaggatagtctcttcaataaatagcgtttagaaaaactgcaggcccacatgcaaaataatgaaatttgacagttataatatgcacaggaataaattgaacattgaaaaggaatttaaacttaacatctgaaaccaaagaatccctagaagaaaccaggggaaatcctccttaagattgaccttggcatgattttttggctatgaatctcaaaatatagacaagacaaacaaaaataaacacatggaactacaccaaagtaagaggttgctgcacagtaaaaaaaaaaataataattaattaattaattaattaattaaaaaggtcacccatggaatggtagaaaatacttgaaaacaatatatctgataatggattaatatctgaaacagataagaaactaataatcagaaaaaaatcctgattagaacatgagcaagagacctgaacagacttttttccaaggtagacttgcacatggccaacacatgaatgaagaggtgcacaaaatcactaaacaagtgggaaatataaactgaaatgaaaatgagatgtcacattacatcttttaaaatggccaatataaaaagccaaaagatagatagtgttgacaaggatgtatcaaaacgagaatgcttatagagttttggtgggaatgtaaattggtacaaccattatggaatacagcatggagggtcctcaaataattaaagacttaccatatgatgcagcaattatacttttaggtataaatttatatacctgtgggtgtgttggctcacacctgtaattccagcactttgagaagctgaggcaggcagattacatgaggtcaggagttcaagaccagagttgccaacatggcgaatccctgtctctactaaaaaccataaaaattagccaggtgtggtggtgggcacctgtaatcccagctacttgggaggctgcggcatggagaattgtttgaacctgggaagcagaggttccagtgagccgagaacttgatgccattttatataattatcctttcacagacaaaagaaatctaatcactatcttgaagagatatctgcattcctgtgttcattgcagcattattcccaaaacccaaaatatggaaacaacctaagtgttgatagatgagtagtatgtgaattgtgatatctatcatctatctatctatctatctatctatctatctatctatctatctacaatggaatatcattcagtattaaaaagaatgaaatttggccctttgtaacaaaatgaatgaccctagaggatattatgctaagtgaaataagccaggcagagaaagaaaaatactacaggtacaaccatgcaaacttgccattataagatgaataagttagggagatctaacgtacaacatggtaacaatagataataataatgtatgctttaagttcatggagtgtagatcttaagtattatcctttcccaacatgtgataactatgtgaagacatgaatatgttaattagcttgatagtgaaaatcattttaatatatacttgatgggcgcagggtgagaggagagtgagggtcaaaacactacctgctggggactatgctcactagctgggtgatgaaatcatttgtacaccaaaccccagcaacatgcaattacccacgtaacaaacctgcacatgtacctcctgaacctaaaatagaagttgagaaaagaaaaagaagatatcagtttcctatagggagctccaggtttgttccaaacagtagagagacaaacctatcaaggatgaaatatatacaagagtaggcacaacttaaacaatgtgtgtaaggcaatcaattctatataactcagcaactcctaggcttcttatcaaataaaatcactgatgtgtcataacttctaaactaaaaacaacacaaatgcccattcacagtagaatgaataaataaattacttttgcttcccacaggggaatacggcacagcaatgaaacaatgatctgctgctacacaaaatgtagatgattcttacaaacttcaactgagtgaaagaagtcagactcaaaagaatacagatagcaactttccatttatatgaaattgaggagcagggaaatccatcgtgatagagttcatgataatgatgacctttggtgagtaactggttgagaaagtgcaagagagtggttgtgggagctggaaatactccatatcttgcttgatttgagtgatgatggggatatatacacttataaaaattataatgctatatgcttaagatttatgtattttactatttgtaagatatatattagttgaaaaaatgctgcagtgtaaaggaaaccagtaaaaatatgctacctagaattgtagatttgtttaacaaaaaagcatttgagtagtctattgattattagttagcaagtttatattaagcatcattgtcctgaatactttttagtatgtaccagtaagtgtttgcctttctcaactagggctaattaaaaaaaactcaaaacctcatgttgtacacattgaatatatataattttaacttgtgaattataccaccataaaactaaaaatctaattaaaatgagttcgaataaattttagggaaaataggataatgaaaattatgagcttaagaatatgcatagataaaaaataaactgttgatagaaattttattgttatatttcagaaaatcatataaaaagctgtgctaaaagtttccagagagagagtacatagttctcctgcagtggattaaaatgagattagcattggagtactagtctaaaaccacagatagagtctggagtcagatctcagaaatacaatatatttgataagtaatgagagacaagttatttaaatttttgggacctaaacatccagtctgtaagtttgttgaaaaaaataaacaggctaaagagaccttaatttacagggagggctaaattattacctattattgtaaaacataatagcagtgacattaaaagcttgagtgctgtagaacaatatattgaaaatcactttttgaagttatatacatatttatattactttaataatttgcacaatgtaggaagaaaagcttgctttgcacaggcaacattttgccaaataatctccaaatcatcatgaattctcaattagtcagattaacaataataaaattttattgtagaggaggattattttttcattaatatatttgtacctacacatagtgtatatgtaatattttgttacctgcctggactttacaatgatcaattcaaagtatccggggtgtccataacctcaagtattatttccatatgttaagaaagtttcaagtcctttagctattttggaaaatacaatacattgctgtttatatgtagtcaccttactctgctatgaaatattagaacttatgtcttccaagtaactgtatgtttggacccattaacaaacttttctttattcctcccacccacagaaactctttccagcctctggtatctatgtattattctattctctacctccatgagatcaatatttttagctttcacgttctattcttagaataagaacatgtgatgcttgtctttctgtgcctggcttatttcacctaacacaatgacttccagttccaaccgtcttgctgtaaatgataaaatttcattcttttttatggacaaaaactcttccactgcttgtatatataccacgttgcttttattcattcatccattgatggacacaggttgatttcatatctttgctattgtgaatagtgcaataaatatgagagtgtggttaactctttgatatactcatttattttcctttggatacatagctagtaataaatagcttgcacctctggtctcagctacttgggagactaaggcaagaggattacttgagcccccgaggtttagattgcagtgagccgtgatcacaccactgcgttccagcctgggtgacagagtgagaccctctccctcctcaaaaaatccttaagaaatatgttgatgcctggttcccttattcagaattttcatttgatgtgttgagagtgtagcacagaagttggaataaacctctcaaactgattttgatgtgcaaccaaggtcgggaaccaccaaggaagagtttttatgcataaagattcctatactctatcctagaactaatacatatgaatctctgggaatggagtataagactcggatttgaaaaggtgtccttagttattctaaggactgagcagtttggatactggtttgttagagtaaaatggttaggtacctagtatcaacctagccatctaaccttatattaacaactaggaaaataaagggttggagcctctgtgtttctttgctgaaaaatctgctgctattcttagttctatgaaaacaaattcaaaattcggttattatcaccttaaaagtacaaaacctatagatattgaaaatgcaattatttttctacaggcatagttaaaatgagtttgtatatattataaatcagtttctttataagtcatttatttagataaattttgttatactgacatgattcactaattttctaaatataaatggttcagctctcagttatttttaaactaaagagctgtgttatacttattatttctaattggcttttatgatgttttaggtttcttttgaatcccgtgtccttcaagtgctttccaactttgagaagaagaaattgaccacccggactatggaactgtgcgtaacagctttgaaagtgtatttaaaaattaaatctgtatgcctttaaatcagtgaattggaaatatattacatgtattttaatgactttcctcaaatacaataaattgttttctttccaatggaatggtgtttgtattttttctttacctggtttaacacatgtaggagaacataactagatgattacatcaaattctttttaaggcaattttataatatattttatttatgattacaaaaactgccttttaaaagttcttgcctggatatgaatgcagtttcacattttttaaattgtaatcttgctttttgtaattattttatatttgtctggcttcgagttttattgggttttagttttttggaagtgggggatttatcccaatttagaaatttgtatccttgccgtaatacagtctaccatttttgttctcccagatctttcatctgtcagaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacaaaacattgaaaaacttcaggaaagatataccctgtacccaacatgaacgaggtcaaagcaatgaagaaaaagctaggaaatcaaataagtctagaacaactgtgactaatatataaagatttgaggtggttatatccatttaaatggtatcaattagaaaggaaaaaaagaggccaggcacagtggctcatttctgtaacgccagtactttgggaggccaacacaggcaaatcaacctgtggtcaggggttagagacaagcctggccaacacggtgagaccccgtctctactaaaaatacaaaaatatttgctggacttggtgtcgcgtgcctgtgctcccagctgcttgggaggctgaggcaggagaattgttttgacccagaaggggagattgcagtgagctgagattgcgccattgcattccagcctgggtgatggagtaacatccaaaaaaaggtattttacataagaaattttattttatttttctgtaaattataaaatagcacttaatatggaatttatataccagaatctttgaatatccaaaatttaagatgagagcaattttgagaaacttttcaaagcttaggaaaaggtaactacataaaacaccattatgtgttatttatgggtacattagatgaagtaagtcacaaaaacacgcatagaaatgatcatataaacttgcaagaaattgaatgtcttgctattgaaggaaaggttgaggtgtaagagattgaggttgagtgtgagaagctctgtatatattgtatttttcttaaaaatatatatttaaactcacatttcttgtttttcaaatgttcactccaatgaaaattcttttacttttcctgttagaatttttatttccactctcacatatgcagtgtactattgttcagaaatattagtgatcctccttgcaaatgaatactcccatcctgctgattttcagaaggtccaagtgatttgctttggctgtgaaatgtaagcagaaagagtgttattttggggacttcccgattgcaaaacaacatagtatcgcaacttttgacatagcatttacgttgcattagtcattataagtaatctgagatgatgtaaaggttatatggaaatactacattttatataaaggactcgagtagttattgctttaagtatccatggtgggtcctggaaccaattcctcatggatatggaggcacaaggaaccactgtagttaaacaaataatcactttaaaacttaaaaccttttgcatggtgagtacagtcatgcaccgcatatatgatggtggtatagttaagtttattatgccatacatttattggaagtttcctatgtttaaatgtattgagatacacagctacactgctttacagttgcctatagtattcagtaaaataacatgctttacaggtttgtagcctaggaggaataggctatgcaatctaggttaatgaagtccattctgtgatatttgcacagtggcttaattacctaagggctttgtcttcagaacatactcctgtcattaaggaatgcatgagtgtagttggacaaaaaataataatgcaggcatacctttggcactgtcctaattcttaccaacatccatgattgcttaaatttgcactggaaagacttcaaaaaacagtgatatattaggacagtatatttccaatacatgacaaatgataacaacataagaactcaaaacattcaataagaaagaacataacaattaaagcaaaactagatgggaaaaggaagaagcaaatttcaagagaaaactcaaaaggccaaaaagtgtgaaatgatgttcagccttgctagtaattgggaaaaacacaaatctctttttttttttttttttttttttgagagggagtcaccctctgtcgccaacactggagtgcattggggcgatctgggctcactgcaagctctgcctcccaagttcacaccaccattctcctgcctcagcctccaaagtagctgggactacaggggcccgccaccatgcctggttaattttttgtgtttttcgtagagacagggtttcaccatgttagccaggatggtctccatctcctgacctcgtgatctgcctgcctcaacttcccaatgttctgggattacagctgtgagccaccgtgtctggcccaaatcatttttaatctattaggcaaaaattagagctatgataatattcatttttggtgggagtgtggcaaaaggtactataacagaatgctactagagagtaaactttgatacatttgtaagggcaattttgcataatatgaaaatttaaaaatatgcttccagtttcacatacgtttatctagcatacagaattacccatgtgtaaacatgtatacagatgttcattataacacttcttataaaaacaaaatatttgcaaatattcatatgaacaagtgcatacatatgatcttagtccagttagaattttctgttttatttcaatcctttaaaagactcaacttctgattctatataaacaattcaaaaaagaatgtgttttccctatgtgcatttggtcaggtaaattaaaaaatacacctcatgctagcctcacaaaactggaataagccttgggaaagaagttgtccttgaagcttgtatctgacattgtagcaggacgagccgcagaaaaaacctctcagacactgagttgtagaaggaagggctttattcagctgggagcattagccagctactgtctctaaatctgagctcctggagtgcacaatttctgtcctttttaagggctcacaacactaaagatttcacatgaaagctttgtgattgatttgagcaagcgaggtatacatgacaaggactacttgccccggtggtcagggagaaacagaatatggaagagagtttcacaatgttcttctacacaatatctggaatctgtgaatcacatcggcttctaaatcataagtggatgttcaactactgggtttaggccaaccaggcccaggtctgtttttgggcctggcgccgggctgcctgtctttggttttatttccttgttgtttttactgaatagaaaacaatgtaaaacaagaggagagggtctttctcctctctcattttctttctttgagactttcactcatttttattagtgggagctgtcacttttatgatttatgttcttctgtgcaatagattgatagccatttatattgtatgcttgtgctgaaggcttttggtgaaataagggagagacgaagttttttatgatttggagaaacacaggtatcagacaagggagcagtaagcaggttcctattactattattacctctattataagagttttaaatcctcctattgctgggaactactttctaaacatggctcctggattgagtctgtgccagccttgcacgagtacatgtgccagttttgttatatccttaagtatatgctcaactacttgttctttatcatctatgtgtaggcaacatgtttcgtcagattctctcgccaggcaagaacagtcaaggcttgttgggttttattagtaataatttctaaagcagcttgtaaccatatgagcatgtagataggggttggatatcctcatgagccatcttgtacttaagtggcgggtccatagtattgtatgattctttcaggggtgcattcatcatctttctaaccacttatggctatgcttcattttgcctgggaagcatagactgggaagcctacaagttcaactgtttttatgggcagtaagaagaaagatggcttcatggtgccaattacacagccacacgcccactggtcaggcagcttagcataagctttgtgtctacatatctagcataacctagtgggggccgtccagtcctggtggaattctggatgggcctaaacagtctgcaactttggaaatttgctgaatgcatttctttctgtgtaattggaactgtaccatgtaactgtttttgtggcaccattatacaggttttgcctaagacaaataagccgccttacgggatgagtaaatccttttctttctctagctacgcattactgtctaataattgtgacttttagaaactaaaaattgtcggggttgttcttttgggatggaattcgtgaggaactccatctgtaggaactaattcttgggcttcttatggccattgatctcctgttacagtccttccacaaacatcacatgaaatgacttgtagagactgggctacatgtttggctaattgcaaaaacaaatttttagtttttttcagaaatttcaggtataggcacattgaattcatcatagaaagtgtgaaatacttgtcctggtgagcgtttttgaacttcttcttttatcaggatgcttacactagaatctagtccttttctatcaatgcctaatgttatatattttcttttattccactttggatctgaggggtttgtgatgatcaattttaaagggttgcagctcccacttgtgcaagaggggctgacttttcttttttggagccaaacaggatcttttttatctttcttctaagtagcctaactgacgcaataccactattgacacatcgaacataaatatggttcttgacagatgtacttattttctgtgtgtaatttttcccaaatttagagaaatgcatcttatcctctgctgtttagtattaatagtggcacgagcatcaaattttaaagttacatttgtggggactcttctttcttctgttctagctatcactttacttgtgttacttagagaaggaccagttcttagtcttacttcgaagactgtgatcatgggggtttagaggggtcatagcacacatcgggctggtcacttcctggattacatacttagtactgggtgttattatacaaacaggttctgtttggagttcttaggcattcataatagctgtaaaataaaacgatcatcttaacttgtccttcttcagtgtcctgatgtatgcactgaaggcagtcctctgtgtgggaagaggtagtggaagcttttaccacacaggtccatgttataaggacaataagtcctacgacgattttcctcatgctttggccatgtgtagtctagtcagcttcgtggtgtgattggagcagggcttgtcattttcttcaaggtcacttttcagggattgtccaagtttggtttggcctcctaggtctcagcggctgcaggcttcatgaggctgtggtgaatctaggctgggattccttctacattgacagctgtgggagtggtcaggttaattgtctggggtcctttccactgtggccacagcggagccacgttccagtccttgatccacacaatgtcacctggagaaaaagggtgaactggggagaatcagctgcctgggcacctctcatttactcaagttgagatagtctgagtaattttccctaaggcctgtagctgccgctgtaatgcaatctcacctaactcttggggagtacctggaagccctcccagtatgggaggaggcctatgatacagaatttcaaagggggagtatgctgttctcttagaaggggtacacttaattttaaacaatactataggaaggacttgtgtctattttaaatttgtttcttgacatactttccagaaactttttctgatagttcgattcatttgctgcactttccggaactctaaggttggtaaacggcatgtaacttctatgaaattcttaatacctttgccgtcttctgtatcaagtcagcaacaaatgctggcctattatttgagccaattcgtagaggcagtccaaacctagggatgaaattttgaagaagtacacaggttacttcaggagctttttcagttcatgttggataagcctccacctacttagagtaagtaaacactagaaccagtaaatacttgttacttctacatttaggcatttctgtgaagtccacttgaagatcttcaaaatgagctgctccagaggcttctattccccgaggtacagaggggccttgcttcgcattgtgctgtccacaggtaaggcatcactgcgctactgttgtagcaacagctggcaagggtgagatgtagaaatactggcctaacagcttttcaagtgattcttggcctcaatgggtagtttcacatacagtcagcatgactgtatagcagcggtggcactgctattcttccatctggtaactttatgtatctttcctttattgtttgtcctctctctgtctgaaaaaattctttttcctctttagaataagttggcaccagatcaagcatttgaaggagtagcagggctgtgactgatgtctggtaaggagtagatgctgcttttcctgcctctgtgtctgctcagggctttccttggcaaaccgaagcggaaactcgctgatatcccctgcaatgcatgaatgccaccttttggggtttctacactgcttctaatcattgtagaatttcttgctgacattttatgtcttttcctctagaattttttccttatacaatgctccacatacttgaagggttagaaaggcatatcaagaatcagtatagatgtttacaatcttaggttcactgagttccagagcccgagttagaggaatgagttctgctttttgggctgaagtgctctgaggcaatggcttagcttcaacaacatcatctaagtttactactgcatatcctgcacacctttctctttgcgggttgatgaagctgcttctgtccatgtagaactcctaatctaccaatgcctatggctggtctcaaagatctggtctgctagaatagacatagtccaacacctctacacagttatgtttaacagggctgtctgatactgggagcaaagtggcaggatttaaagaattacagacttctatggttatacattgattttcacataacaagctttggtgtttagttaatgtagcatttgttagccaatggtgtcttttggtgttccttagagttacattagagtcagcttgggctgacataagtttttcttttaacttataagtcttgttgttgtagagacctctatttaaaaggctctcggtcaccccctttataactccattcaatgctttggctaacaccacaaagtttggaatctgcagtctgcaaaaatctcacagctcctaaatgttctcttatttgcctcctggttttaggttctggtaagctgcagatgacctgctttcttgctgaccatagactgcactccccttttcaaatagtgaatcctaggtagtgtacctgctgtctgcagatctgagctttctttttgggcactttatatccacagtcctccaggtgtcgaagcagggcacccgtcctttttgcacacctgactgccatggagtgtcctagcagaaggtcatctacatactggagcaggatgcaacctaggtctttagcaggaaacatttggaggtctccaaccgaggcctccccaaagatggtgggggactttttgaacctttgggaaagtcgagtctaagtgtactgaatggtgacatctgactccggatcttcctactgaaaggcaaacagcttttggctctcaggaactagcctgatgtgaagaaggcatctttcaagtcctgtacgggtcgatagtctttggtccttggtttagggacaggtaggaggtgggtgttccatggagactggcaaggaactagaattccagaggcttttaagcatataagatgagtctctattcctttaaaggcttccctgggaacaggatacggcttttgtccaattggctaggtcgtaggctaaacttctatgagtacgggggcttgattgattgccagcctcagaggattgtcctccatctctactcagagccgtcactcagctggagccacttttatttcctgagctggctcagttagcaaaagtctccactcttcttcctgggggactggaagggccatgatgactcctgtttctggcaactccagctgtaaagtgccttgttttgtcaaggaaatggtggctcttaacttgctaagcaagtctcttctcaacaaaggcaagggacagtcagacatatacagaaatggataaatcactttgtgtcctcccactgagcagttgcgcggtagacagaagtcctgcttggtagagactcctgttgctctaattctatcaatggtctttatagatgagggggccactggagtgcttactactgagtgttcggctcttgtatccactaaaaacttaatgtccttgccccttattgtcatcctgaccatgggctccttgggggcatttgagcctgttccccttaattctagcagcccctcagctagattgaacaaaatcctttcatcttggtttgaggtctttggctctgcatcactctgattttctttgagttggggacatttatctttctaatgtcctatttctttacagtaggcacattagtcatgctgcaaatgtgagtgattggacagggcattcctcccagaacccccttttttctgccttttcaggagaattcctctaattgtcacagccagcaaactagcgtttcacctggcctggcgttcgccctccttacggctttcttggccgcttgttgcatctctatttacaaatacttcattagctctttccagtaactgcaaggttttcattcctgcaaacctagcctgtttttgcaattttctctggatatcttctgcactctgaataactaaggccgtattaatcaacggctgattttcaggactctccagatcgaaaggagtgtacatgcaataggcctcacacggtctttgatagaactgggctgggctttcctcctttccttggatgacttcagaaactttatttacattggtacccttttgagccccttttttcaacctttcaattaatgcctctcggtaccctcttagcctttccatatctggtccttcatttggatcctattgagggtccgttcctggcagctgaattcttatgtattcttggggactttgataattggctgggatgtgctcctccagccatttaactgttgcctgcagcacctgttgccttttatgtgttttaaagaggtacatgagtagctggtggcaatcagcctaagtaggattctgagtctggataattctttgaagcaagtcaattagggcttgaggcttttcagtgtaagatggagtgttatttttccagttgagtagttcagcagaggtaaaagggtgatacacaaaagcatgcctttctaccgtatgtctgacctcatctgtcctagtatatcgctgctctctcagggcatttgaattcccgtcttgggccgttaagcgggctgccagggaagtggattttcccgcagtttcacttttgttcttgtctactctgggtggtctaggggctgtgggctcaggagaagggggcctccccactggataaggggttgagggcactgttggtgccatctcctgccttgagtcctcgagctctgggtcaaacagaactttaggtgctggcttctcttggccggtggagcgagaactttcctgaaataaatgtccctttgctactactactgctgctgcctgtccttttaccactgtagaggatctaaaactagctgtaactaggaatctctatatggaaattgatatgggtgcaggcacaccatgagcgatcaggccaagcttccgctcaggtggagtggggcaagttgaaaagacttgtcttactaagtttcagatgtctggactccaagtgccagttccttcctggtgttcagccactgtgttaatcctccgcggggatcactgctctggcgaggcgttcaaccggggccatttcctacctgggagcgctctttggatcccatccctcaggctggccagagtccctggcagcctgagggatgccccggccttactccacaaggcatgcctaatctgcctaaggagctgcctcggccgtccatcagttatcttgcttccaggtcagggaaccaagaaatgtagcaggacaagcggcagacaaaactctcagacaccgagttgtagaaggaagggtgttattcacctgggagcatcggatagctactgtctcaaaatccgagctccccaagtgcacaatttctgtcccttttaagggcacacaacactaaagatgtcacatgaaagggtcgtgattgatttgaacaagccagggatatgcgacaaggactacatgcacccgtggtcagggagaaacagaatatggaagggagtttcacaatgttcttctatacaatgtctggaatctatgaataacatcggcttctaaatcataagttgatttgtaactactgggtttaggccaaccaggcccaggcctggttttgtgcctttgattttgcttccttgttgtttttactgaatagaaaacaatataaaacaagaggacagggtctttctctcttctcaatatcagcactggattgtagaacttgttgctgattttggcctggcattcaagttaactcttccccttggtatctgtacatacctttgatgtcagtgtttagtacacgtggcttggtcacttcatggctaaaaacgtgcttgtggaagacaagtctggcttggtgagtctgtgtggtcagcagtctctgatccgtgcagggtattaatgtgtcagggctgagtgttctgagatttatctagaggctgggaagggctcctgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggtaaatgtattcatccttttaatttatgtaaagttttttagtatgcaattctcgatcttttaagagttgacaacaaattttggttttctgctgttatgtgagaacattaggccacagcaacatgtcattgtgtaaggaaaaataaaagtgctaccatatgcaaaaaaaaaaaaaaaagaaaagaaaagaaacattaatgtctaagaggtcattgagatgatttccatgagagactttttgatgttcttcaccagttaggattattattgataatccttttcagattatgaataaacagtttgccctcaagtatttattcatgctactatttacattgtaaaatgtgcttcttacaggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtgggtatgattcatagtatcaattgcagaattcactgtgcttgtagtaaacactattctgatcttctacgtgaagcttgggcaacattttacttcacaggtaagtattctaagtaaaagaattttctgaggaaaaaacaatgtagtattctttgcaactgtatattttgtttctgatataatctttcttcaacaagagccctccgatgtgctgttaatattttcaagagatagctgcctataccaagattcaagaatcttttgtattattgattagattctagaacattcaatgatatacagtaagacagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggtaagtgaattctagtttcctttaaaaataacagataggaaaatgatttctgtctcttctttcttgctccttttgagcagaaagttttccatatcagttttaattttacttcatactttaaaactcaaaagtaactgtcaccttatgttcaatttttgaaaatatttgtatatgtgctctctactaaagagataagttaaagtttatagcagagtttacttctgaagcaaaacatcaaattttaaccgctataactatccatatttcctggaaggattttctggtgaggaattttaattccagttacaatatttgctctcatttttagatgacttgtgtctccattcctaattcttgggttttttttgtggtgaataggtagcttatctatttaatgaggagcagaatttgagatgaatagctaccttatttgtcttccaagcttagtagagagtacaggctttctcctggtgacccactgaaatttcccaaatagtaaccttttcagtctcatctgagttgtgtctccccaaaatgggctttttgcctttcctcctatttatggtagtttccggttctctcagtttatcattcctatatatatttggccaagtgtctggaatgaatgtaggtgtttagttcacattactttcctttcacagttgatttttgatcttgtaggaaaatagttataaggtatgaaatattttggaattttattagcacactataaatttaatcaataattctttaaatttctgcctctctgtaagtcacactgaattagaaactttgttttctaggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtaatttttttacgagagtgatctgaataaggagtgatatatgccttttgttgtagacatgtagctaattgaacttcgttgtaaatatgaatttagatctcttagggacagaggttaacaagtttgactactttaagaaactcaaatccatatttgaaaacctttaaatattgatttaagatttttaatcaatacacatttgtccacttttaaaaagctcccaaccaattgaaaaactcatcgactttatttcctaagttctctattttctattagaaaatatttccaagatacatctatagtagaatgtgagcatccccagtgtccaatgcaaggaagtcaccatagaatatctcttgaggaatcatggaataaatgaataatcaaatggattctcaggcgaaaagtgaggttttattaatcaatcataacattcttacctcaacaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtacgtcaatacatataggcatataaaatatcatcctattcattagaaaattcacggcagattcaattaaaaatgcaatttctgtaggataaagactgagtcatttccttaaaacagtgttctttaacctcctcttcttcacatacagcatatctaattctttatcacaacaggttttatggaggtacacagaatgtaggatactgataatagttatgtctttattttctttggaaaatgaaatgagttaatatttatcaaaaaaagtcagtcagatagtaaatatcgtattcctgtgagctgttattattatcattgatgtacaagactaaaaattaggtaagtattctcacaggacaacaggtaactttgacattatgtttctttcaatattgtagtgtatactttatcaaaaaaagaatataagaatattaccgatgaagataataagaataagaaaacgattttgagcgtttcatataacaaataggaccaggcgtggtggctcttgcatgtaactcagcactttgggaggctgaggcaggagaattccttgaggcctggagtttgggaccatcctggacgatatagcaagaccctgtctctaaagaacaaagcacaacaagtctaaaataactcagaaatagctgaaagctaatttttatataatataaacttatcggttaaaatgctttaaagtccttatgcaaaatgtttttttttcctaaatttcttctaggtaattgatctgggtggtgagccaattaaaagcagtgactactttggtaatggccgggtgacagaattcaagtatggtgcaaaactcggcacagttattcgcaagtggaatggagagaagatgtcttacttaaagtaaataaatacaacttttcccctgaactatttcatagatctgttagtcatactaccccagtgcgagttatcttctggaacattcttattcagacaactattaaggagtcagttgttaatgataagtattctagtgccctaaactctaatcaatcatcttttgtatttagagtgtctgtcacaagacagtatgcctaggaacgctaaacttaccctaggagtttctgtctgcgtacaagatgaatatactggatttgactgatgtttgcatataatcttttaaagccaggttattattaaaatgatcctatcatttataaagtatgtacaaagtgtccatgctattgtatttacttatacgaattggaaatgtaaaatgatttatattataacaatacaatattaaagccttattttaatctagtttgacattctgtataatgtgatgtggatattgatccttctggagtgcctctaaatgataatgtgctgaaacctctgaaaggaaattttttaataacaaacattttatatttgtaatatgaatataagtattccatacatgtatatacaaatatggactatatatatgtagattacacacgtgtgtttgtttatgaggtgtgtgtgtatatatatgtgagtgtgtgtttgtgtgtgtgtgtgtatatatatatatcttacagagtaaccatctaattagagaaagaatttaatcttcagatgccatgccttacagaaagagatgcacagtagagttactctcaaactattgtgaaatgatacatcaacgtatatcttatgtttcaaaaataggaactggggagaaggttggggtttcatgccttctgacagagcgcttgtctttgtggataaccatgacaatcaacgaggacatggcgctggaggagcctctatacttaccttctgggatgctaggtaaaaaaccaagttctctatttttttaacacctcttttaatgatggtatgaatattgtgatattctatgataatataattatgtaactttcaggctgtacaaaatggcagttggatttatgcttgctcatccttatggatttacacgagtaatgtcaagctaccgttggccaagatattttgaaaatggaaaagtaagttttggagttgttcaaaatatccttttctcaagaaaaaagaggcaatcttctcctaatttaatatgacaactattaagtgtttatttattcaacaaatatttaattattgtaaacctgatacaggattgtgatttagtaatgcaggttatattaaaggaataaactttatattctccattgaaaaagaatagcaagctttttcagagatatgacaaacatccccctagcccgcagggaaaataaaaataaaaattaaaaaaaccacttaaaaataagagctaggcacagggattaaaatatatacttcgtaccttcctcaggtttaattggaagaatatagatgccaacccttgtagagaacttaaaacatcatctgcccgtagtgagaacaatataaatgtcttttaaatactgttaaaaagttatatggaatagaaacaaatgatccagttcagctgagttaaatagggaaagtatactataagaggaaggaaattgtatgtactaaaggatagaaatttatagagagtattccaagaaaggtaagaatgagaaaaatatttgggagtatggtaaagacatcactctgctgagtagtttcaaaaaggaacagagaaataagagtgtaaagatatttggaaagctagtagaaggttttcttttaaactaaagggttgagaaacagcatcagagacttcagaactaaagcagaaattcctccttcctatgagtcacacagatatctagctagctttttttagattcctttcagtttgagaagtccgctactatgtataacaactgattctattgttaaacagctttaatatttagaaggtgtacttttatattgagacaacttcttataatttctactaattggtcttatttctgttgttaggagtcagagagttcttttattttttctattactataacattcccactttgacaggactgctgcatgctataaactcttaagttttgttcacttttcaccatatgacgtgattttaaggtgaacactgataaacttcctagggttactctgtgttttttaatgaagatttcttaaagtgccaatcagaaaagcataatactaaaaatatggtcaatttataaaaaaaaaatgttcagatgtagtattttgtacatttatctaaaaagaagcatgacggcctccaatatttatttagcatatgtcatgttcaaggcattttcacatatattacttaatttttatagcaaaagaactcattattctcattttacaaatgaggaaactgagacacagagaaattatttatattgattaaattttctcagctactagtaatagagcctatgttttaatcctggtgtttctagtactaatgcccttcccatttcaatgccattgcatggcttacagtgatgttaagaagcccttgcaggccaggtgcagtggctcacacctataatcccagcactgtgtgcggccagctgagaaggtcagctgacctgaggagttcaagacctatctgggcaagctagcaagaccttgcctctactgaaaattaaaaaaaaaaaaaaattagctgggtgcggtggtgcacaccaacagtcttagctacttgggaggctgagatgggaggttcgcttgagcctcggagatcaaggctgcagtgagctacgatcatgccactgtactccagcctgggtgacagagcaaagaagtctttgcagtgccttggaatgaaaaggagaggataacaatttgctacctttgtttgaaatatggcaaaagagaaccagaggatagagagatgatgaagacccagtaaagggctataaaaatcaatgaaggcattggattctagataaagtcactgaatgcagagacacaagtaacaggataggttgggtttggtttaaaggagaaggaagagataaatatatatatgctaaaatttggcttttcctcctgtaattaaggatgttaatgattgggttgggccaccaaatgataatggagtaactaaagaagttactattaatccagacactacttgtggcaatgactgggtctgtgaacatcgatggcgccaaataaggtgagaatatgtatttagacatgtcctctaatagtaaatttccgtagcactttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtaaatatcaattaaaaataatattttgtaccagtatgttcttggtttattcttttttttttctgttcattgacatttatcatatctgaaaaatcatgtagtcagtggagcgagaagacaatagagatcaaaattgggtagaagcaaaaggatgatggctgttactccttcgttctcctgttttcataagtgctttctgttgtaagcagaatcctttctgtgcacccttgcaatatcttatgcatatatagaatgcacattcatatgcttacctacacatgccacaaaatacacaaagtaattaatagaaggattgtgaaatcattaaaagaacgtttcttatagtcctgctcttttaatcatggaaaaatgctgcctcagtactaaaatatctttatttctctttttctcaatgacagctctacctagttttttggtatactttcttcacttctctgtctccttgtgacaaataacatttttaaagcatatggataaataatatgtatcttgtggttaatgatttgcttcaggagacttgagttttagttctgaaacttctcattattggcctttcatctgtgatttttgtatcctttggctgtagtataaatgattcccgaaactgtagctgagaagacctccttgcaaacagttgaattgtctctgtccaaggccaactgacactcatacttagctcactctagtataaattatacttcacttatgaaaaataaataaatacaaaaatatataagtcaagttgatctctttcctgccaaaaaaatgcgtgtctatttccttagtttccttcttttgtggatgaaaataccaaaaaaatcttttgtgaaaaagctttatatttcaaactatcacttcctcatacaaatgctagactgtttttatgtacaccctaaattctttttgacctcatgtagaataaaagaaggttaaaaaaataataccctttaaatttttaaagtaattggcattaagttcagttgagaaaaaatttgattttaccaaggtagcactttatcaaaatgtgaccgctcccgccaatcttcggtgatattcttcaactttgatttttcggttatattttcactactgaaaaggaaattggtaggttttctgtaaggttacttttggtcctagaaagctgtttacacctactagggaggcatatgggttttcttcttaatgagacttcactgcttagggttctaaaacataaagttatgctgtttatttgtgttagtctgtattcttgatttcattgttttgaagttaaatctgaaattttattttacaggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaatagctaagtgtgtttcttttcttacatatacagtaatagttacatatcattaattttaaataaaagctctaattagtaaaaagaggtttaagacacttgatagtatgaaatacaattccaggttacacataagttatttattttggcaaaaggatgactcaaaaattttaaaactaggcaacaatctttactcattaagaggtaagacttagctttccaaacagtttgtctcctgtctactcttttctctccttggcattctaccaacaaggcaaaccaaatatttcattattcttctctattacatgaaaaatctgtacaagggaaggaaagccaaattttacccttacataggtttcaaaagaatcctttttccataggcaacatttacatttttatgcctttttataatcttttaccacaaacacatttaagtgttcctacacaccttgcatgtaaatttatttttagttgtcttatttacatatttttatggtcaatcttagcaatttttaactttaatgtaaacctggtaagttgttttaattatgtactagatgcagataaagtctgactttttccattctagttagggcatggttaatttcatatgtccccaggccttaccaagttgtaaagtaggcagcctacaaccttgaaatatttagcaagccttttatctaatttatgtgatttaaacctgctatttacatattgatgatatttgcattttccaatttgatctttaaaacagtttttatttcttagagtttaaaaacacataaactaaaaggcattacggttttaactttcctctaaaatatttgatttaagtgcttatttttatttaaggcaatcaattggtcctcgttacagacatcacacacaacacatatattgctacacagacaaacagaagaagatccagtagctctaagatttcttctcgtcccatttcctaattgcattactggcttcccagtagagccctttaagaacagggatagcaaaccacgaagtttctagggcctaatcaacttgtatagctgtaagacaaaaacagattttgagcaggattgatcagcctctagattctgggattccatgaggaaaacagaggtttctcccaaaatggaatccatcatgcattttctgtttttcccaaaacgtttcaggccaccagaagttatcttgtgtgcattaagagtggaaagacagagtggagaacagtaattcagtcaatggaaaagttcttttcaagaaaaacacgatccaagaagacaaaaacatgcaggtcttttaaatatacctataacttgaatatccacttttaatcaagctcagcaccctttcagaaaatcctttgacatcttctgtttcctgactttagctaaatcaagcaggtaatatttctggcttttgaattttaccaaaggtaacatcacaggggaaactaaaaactctccgttaggttataagttcaccgttagtatacaagatattttataagtggtggtaagcagcttttaccagatctagaacctttaaagtcagttgagagaaaggaagatttcagaaaggcagttagagtttttcatggcggagcacgagatgattaaacgtcacacagttgttaactggaaagtattcatcacccaggctgggattgaacctgggtcaccattgtaaaaaggcaacggctgaaaagtggtactaccacatggttacaggttatgcttaaggacataaaacaagtcggagacatgcagcaaagtttgttactgaccagtttatgagggtgtcttgaacagtgagctcaaggagtctcaggcctggattccattccaaggtaccctctgtctgactttttcttctattttctctccttttcctgagcctcctcctagtacgtcttatgaaagactgaggtggctactcttagaaggttttctaaggtgccttctagtcctatagcctgtttctgtagcttccttcaaatatcaggagctgcttgagtaaacctgtctttcaagatgagctgtccctcaattgaattacgagatagggaagcatgttttgccaaagtctctctcagcctttataaaaaggctgagggattttcatctgggttttgatctatcatggatagcttagagtagttaacaggtttggctctggtcccctgtaagacttctaccgtatacatctgaaagtgtttctatttttcaatcatctatgggcttagtagagttccaattagagttttcaagggatactgcctcttttcctactgggaatggggattctgcctgtttctcaccctctttccctttttgactggctataggaaacatgctgctcatctctgattttttctgctacctgtagggctgcctgtctctcaacagcagttagggtttcagagtaacataacatccttctaggagagtttaaatacttgggttatatcctggaaggcctctatacatgagagaagttggcacttgcccagagcgaacttcaggctctgaagtctaaagaataactcaaggggaatgcaggcttgaagatggggtgttacccatgcataaaaagaggggagtagaaggtgtcccttagtctcctttcaacttttgaagtgacccaggttgaagagaaagattacaggggtgtccctcttctctttcctcccatctcctttgggtcctggcaaccatcataggtgcagcccatggatgcaagcatgaattgcacccatgtatctggaggtgctagttggcaggggtagtcatgcttaccagcacaatgcctcatctcactgcccttctgggttcctaggcctcccaggagattgtacagtagataaagttgggtgagacactttaacagagggagtgttttaaccctattcctgcttcctctagctatggccctggaaaagcagtgcattcccagaaaattttacccattgccttttaaacacaaaatcccctttctgattaaatgccaatgttgttggaagcagaacaggtgcctcaaaagaacatatggatttaatggctgtcctccttctgatgggaacagcactgaggctagaatttgtctctcaagggtggcttcctcccaactgttgaatgcggagtttttttccctacaaatggggcatagagtctgcttgctgacagaggaacacaaaagtggaagaaatctgggtattagaggtttttggcaaagggccaacaagactctatgcagaaaaaaatcctatctcatgaggtggtgctgtaggttttgaaaatttaggtaaaatctgtgactctaaatattgattaaaaatcttaaatcaatatttgaaagttcttaaatatggatttgagtttcttaaagtagtcaaacttgttaacttctgtccctaagagatctaaattcctattttaaatgaaattcaattagctacatgtctacaagaaaaggcatatattactcttttattcagatcactctcgtaaaaaaattacctgagtagcatcattgtagttctcgatatctccacttccagttttacatttaccatcattgaaatcccatccagaatatgggactgctggaaagtccctacttccagggttgaagtaacttccacaggtactgcttgttcctgcactcacagcgttaccacacatatgattaattacagcatccacataaatacgaacctagaaaacaaagtttctacttcagtgtgacttacagagaggtagaaatttaaagcattattgatgcaagtttatagtatgttaataaaactccaaaatatttcatg

SEQ ID NO: 1753 - DNA, 64952 bp, Homo sapiens
  misc_feature (4068)..(54067): n is a, c, g, or t
ttgtcagtttctaaatgttcctcaaataaaaagggctcctaacaaatctacagcgtctacgtggtctggctctacctatctgatattttggtgggtgtgtggggaaggttcttctcatgtttgtcttctagttttcattaatatctgtctctctccttttccccaaccaatgcgggatgacagcagattgctggtatactgcttactgctgtatctctaacatttatttaagtggcaaaaagaactgtaagaggaactctggttctccagactgtagcagctacatctagcataaaacctctctttagaatcctcaaggccctctctgtatggggtgaggggtacattcctgaccctccggggatgatccctgcctcactccattcagaatctaggcagaacagtggattagaatgtagacccccagtcagaacaccaagggtcaaaacttagttcttccactttctagctgtgtgatttaacctctttgtacatcagtgtcctcagctgtaaaatagggagaaaagtacctacacctacacacacacacacatacacacacacacacacacacacccctacacacacacacatacacacacatgcaataatttatttattaggttacctctccctagaggctgccatttctgcgaaatgaaccctggcaggggcctatccgtctgctaaatgcctactgattcaagaaaaaagtctgaactctcaacgttttgccccttaaactgagttctcctccctacaatggtgtctaatgagttgacagaataactggctagctttatattttaccatctaaatactgtaagaacatacccggtatttccacacccaagttctcctccttgctattcaggccaattcactttcccaaggccagggattaagagccgcacggtcagctccagatagcgctcgccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccgtgcgccccgccccgccctgtgacggtcccagcccgcacatgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactggtaagggcgcgcccctccggagtctcccgggaaggcatttgggaagtgaccggggagggggagcgctgacaagagtaaaatggaaacgagtggggaagatggacttgtgtgatgagagctcccccatcctacctcttttttatcaaaatatctgctctgcgaagtggagttttaatcggctcgagtctggattagtcatagcactgcagaaaagggcaagtgagaacgacaaagcagaagaatggaaattagcttagttatattgagttttcggatccatcctgagagcctcacaacttttttgaatttggggttatttctcctggactcaagagtattcttacaaatgtgcatcaagggattttttaaagtcctacttcatttataagccaatgttaaatcgttcattaaaatagaggagaagctacattggtgacttgcgtaaattaaatgcagaatttcaactagaaaaagaggcttttcataaaaatttcccgatgacatcttttagggaacaattttttagggctgttaagagtacctgtgtaggaatttacacaattactttgttttgctttatatccaaagatattttagatttctcttcattaaaataggaatagcgatggtgcaagactcagtggttttaaagtttccctaggtgattttaatgttaatgtgcagcccaagttgagagttactgaattagaagaaagaccaattttgatcagtttaaatgtcacttatgcctgcaaattaaaaaaaaaaaattatatatggctcaatttaagtacatcaggtcatcgtgtatcagattagacaaaattagaatgtgcgatataattattaaagtaacttttaataagcattgaccagagctcttccttagcatagtgattcttttactgttgatttgtgtttcttttctgatggtttttaaaatccgtataatttatgtttaaaaatagacttctcccattgaacattattacaaagataaagcacaaaggaaatatgcaccttgaagaacgatttctctgttggtgaatgtttttaaactacgcattgttatgtatagaggaaagtttaaaatctttagatctgtcataaatgaaggaaataaatttttagttggttaaaagtgaccctctgtgtagaacaggtctttaaacttttggtcttttgaactatttgcatgtgtaaaacgtgtgtctttatatgatagaggttgcatagctttcatctcaagtctgactcaaaaagtattgaaaaccactggactgaaattagtaatcagttaaatggtcttgagttttcatcctttcccgtgattttattaacatgtcacattactccactggtaaaaagtcagatttctttgtgagaaactgaaattatattggaagtaatttgtaccttaactctgtttcagaaacatacagcttttgccacattccctaatgaaaaagcagctataaaggtatgactttttcttgacgattaaagttgtcaacaggatcctcttatacaatcttggttcagataatgtttaactgtggtttttaagaagcaaaagcgtttgtattccaacagtttccccaacagactacatttgatttgtcagttggcagatcttgcccagtcctttagtagattatctataaagaaaaactaactgcgtatgtaattaaaataacaatttctaaatgatttagattgataaatatctctgtgactgttacaaggtaagatgtttcaagtgttaaaaggagaatatacatttctttataatgccagggaatcattcacaggaggtgatcttttagctagaagtctaatgattaattggattttttcagaaggaaacaagtggagatgggccttctgggcttgcagaacaccaaataaagctgtgagacattggaagttataagtggagcaggagctaagggttgagatggaaatggaacttgaaaaatagatttgagtctgggagagaggtattgagtttggtttagtaggtggacacttgatacttttgagctggctcataatatgatcaggcctgttaaagatatctggtatagttcatatcatggattggatgtgcagaattattagaggtaggagaccaaatggaaggctgttataatggccaaggcaagaataactatctgaagaagacagtaagaagacaaagggggaagtaaatatatattcaatagagattgagtttgtaggttttataatataggggttgagagagaatagttcaggatatttagattgaggattgagttatttgggttgttatattagctgacatgaggatccagaggatgtttgcaaaggcataggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcactatattaggaatttaaaaatttggtttgtgtttctgactttagatcttagctatctgctttgaagagtcactcactgtctctggacatcacctgtaaaattatggttttaattagataatcattgaggttcctttctactccgaagttctgtaattgcttataataatataatgaactctaggccaggtgtggtggttcatgcctgtaatcctagcacattgggaggccgaagcgggggggatcacttgaggtcaggagttcaagaccagcctggcctatatagtgaaaccccatctctactaaaaatacaaaaattagccaagcatggcggtagacggctgtaatcccagctacccggggggctgaggcaggagaatcgcttaaacccaggaggtggaggttgcactgagccaagatcacgccactgcactccagcctgggcaaccaagcaggactctgtctcaaaaataataataatcataataataataatataatgaattctataattgcttataactggctgttaatcctttctatttttccattcttggttatgtagtagtagttgtttttttaatcacttgagcagatagtgccagattgtaaggaacttaaaaaattgagataaatagtaatttaagaagtttgcagccagtgcggtggtccacgcctgtaatcccagcactttgggaggccgaggcgggcagatcacgaggtcacgaggtcaggagatcgagaccatcctgactaacacggtgaaaccccatctctactaaaaatacaaaaaattagccaggcgtggtggcggacacctggagccccagctacttgggaagctgaggtaggagaatggcgtgaacctgggagatggagcttgcagtgagcggagatcatgccactgcactccagcctgggtgacagagtgagactctgtctcaaaaaaaaaaaaaaaaaaaagaagtttggttttctagttgctaatagtataatttttaaatcacatacttttatgatagttgagaatagttaaaagtatatcttaaacaaatactacctacttgtagaatcaattttagtgcagaacatgaaatatatttttagaaaactgaataattgacgtgcctatcaaatagtgtagtcacttttatttgaaatagcaaaatgttagattattcaacacattttcattcacattgaaactgacattctttgaatcaaaactgtttcttccttctaggtttgatatacgtttgatgaaagaaggtcgtatgaaaggacaagctttcattggacttcctaatgaaaaagcagcagcaaaagccttaaaggaagctaatggatatgtgctttttggaaaacccatggtggttgtatcctttaaatccatctatttcaaaactatataatttttagaaggatataactgaaattaattttcatgttaccctttagaaatttccacaattggcattctagcagtagatattcattcgttacaattaaacccaccttactgagtcagatgacagtgttatttagatttttaataaaagagcttcagcagcatgaggttgttcaatttcagccaagtttaaatgtttcacttatgcagctcaaaagtacataggcatgctaagagactagagtatccagaagtacatttggagtcataaaagaactaattcattttatcattttattgtaatttatatttctacatgagaattttaataactagagtatatcattgattaaccatcttgcttttagtagtcaatgcagtttgcaaactagaaatcagcaagataggtaaagaagcaaaggcccaggtataaaaaataatgactgtaaaggaaaagttaattattaatttcctctcaagtcatgaagagaggcaggaggcactcaaggtaaattaaaaaaccatactcccaccatacactagaaagtttttgagaattatttagaaaagattacttgcatattcatgaaggaaaccttaattttaaattattagcagtttgctcgatctgctagaccaaaacaagatcctaaggaaggaaaaagaaagtgttaaaaattaataaaggtaagtgtgaataaaacataataaaaagacaagactaattcttgagataaaattaagaataaaagtttgacaaggtagtaattcaggtatctctttttttttttttttgaggaaatacctatctgtgcagttaagtcccattaaacgtcaaaactataactacagattaaaacccatttatatgtgaaaattaagtttggagaatgaatcttataaggggagtgtgcctgttactctttttttaactttttctgcctatagtaaagcaatggttcttaaaccctaatatgtatcatatcacttggagagcctaataaaacacagattcgtaggttccttccttccctgaaagagttgatttggtaggtctgatgtggggacctagggaaactgtttataccagttttccttttaatgaggggatttccaggatgctggacatttagtgctgaaatggggaatgtgtctggtaagccaagacaggtcggtcacccttgttggcacctgaaaatttgcgagattaatgaggtttcaggtaatgatgaggcatcttatccagagaccacagcttgaaaactcctggaataaacacttacagatacattttctaactcttaaaattaacctaaagtaaatgttaaaataaaagttaaaaaaaaaagtcaaactgtcattaaaaataattctggctgagcacggtggctcacccctgtaatctcagcaatttgggaagtggaggtgggcggatcacaaggtccagagatcaagaccatcctggccaacatggtgaaaccgactctctactaaaaatacaaaaattagctgggtgtggtggcgcctacctgtagtcccagctacgtgggcggctgaggcaggagaatcgcctgaacctgcgaggtggaggttgcagtgagccgagatcaagatcacgccactgcactccacactggcaacagagcaagactccatctcaaaaaaaaaaaaaatctacagtgctgagtatataaaattattaacacatttcacaacaatatgtgtttgtggagttaaatattttttgtctttaaaacaggtaattttagtgcatacttaatttgatgattaaatatggtagaattaagcattttaaatgttaatgtttgttacattgttcaagaaataagtagaaatatattcctttgttttttatttaaatttttgttcctctgtaaactaaaagaacacgaagtaattggtcacaattactggtgtttaactgccaaatatgggtaaataagggaaaattttgtttaatatttagtccttctgagatggcttgaatatttgaattttgttgtacgtctatactgggtagtcacaagtcttataaacactttagaggaaagatggatttcagtctgtatttttaaacatcatttattttaaatctggtgctgaaaaataagaaaaaaattaaactgcattctgctgttcttctttagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaatagtgtttgtattttttctttatctggtttaacacatctaggaaaacataatattataaaaaatatatataatttgtaatataatttttttatgattacaaatactgccttttaaaaattcttacctggataccaaagcactttcacattttttttattgtaatcttgttttttgtaattattttatatttgtctggctttgagttttactgggcttttggttttttggaaatgggggtttatcccaatttagaaatttgtatccttgctgtaatacagtcttccatttttgttcccccaaatctttcatctgtcagaacgtcactcaaaggtgaaaatatttcccacataaaattattctgttcctttaatgaaatgagtttcagctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatg

SEQ ID NO: 1754 - DNA, 3913 bp, Homo sapiens
ggaaacaatgtcttttaacataagtatctctggagccacaaaaatttcttaagatgtccctatagctcactctattcccttgacctactttggagatacaggtcattagaaatctcatactgcatctacctcaagctgtcagggagtgcaaacgggaagtgcattctggagtaagctgctgatttcttttccatcactctttctttctatagcaattattttctcctgagccattaggcattctctctgtggtgtgtgttctctgcctccaggacatcatctgatggcgagttaacaatgtgaccccctgaactgggcccctcgagaagggccttccacaatgctcttgtctctctgggcttcctcctcattaagtacaacccacttcccaaaatagaaaggatcccactcatggatatcccatggacagagctgtcagctttgctgcctctcatcactctagtgaacaaattatcagtacttggagatgagcttgaagatcactttttactccctatctgattgtagacaaagcaaagcccctggcacaatctcgtcctttttcataccttagaggagttagtaaatcagtgaaggctgagggtttagtggttcatatcatgacaaaactaaatcctgtgtagctgtatcaaacattggtggggtctacaaaatgattgttttctttttcttattttaacaagttctagacaaataattattcatctagcacccactacctgtctatgctggttcccatgttcctcctctgtggtaattctgtacccctgtttctcttagttcttgggtggtgttgggaaggcttgtagtgcctccctcatttcccaggatctgtggtgaaagagctgaactttccattctttctccataaacaaaacaatcatgtctatgaggagtcttgtctccatcagaccatccaaactgacgtgcacatgaaagtataaaagatctggaaggggaggagcaaggaggtgtgtcaactcatacttaggactgtgagtcaggatattttgtgtggcttagacttcttcctgaaaagcaggataataatcagagaaaagtaacaaaatatcttcatttttctttatagtaccatgtatctcgttggcaacttatggcaatgaacttaattcaattaaaactataatttttaagattagtttataatttaaaatttttttaaattataaatttttttatattttataaaatataaataggcaggagaatggtgtgaacccgggaggcagagcttgcagtgagccgagatagcgccactgccgtccggcctgggtgaaagagtgagactccgtctcaaaaaaaaaaaaaaaaaaaatgaccctgacccacacaaaaaagctctaaaattatagttttaaaactataattttataatttaaaaaatttttaaagtgtgttggcatgattggcttcactatttatatgtcccaaccgttgtgtcaggcataaactagggtttgagtgactttaaaacactgacttcctggagcctatattttggggactaagaagacatagaaagaggtgattaagatgcatccctctggctgggtgcggtggctcacgcctgtaatccaaacactttgggaggctgaggcgagtggatcacctgaggtcaggagttcgagaccagcctgaccaacaaggtgaaaccctgtctctactaaaaatacaaaaattagcctggcaaggtggcaggtgcctatagtcccagctactcgggaggctgagaattccttcaacccgggaggccgaggttgcgctgagctgaaatcacaccactgcactccagtctgggcaacagagcgagactccatctcaaaaaaaaagaaaaaaataaataaagatacatccctgtaagaagcgtttgggacagcagggtactgtatgtgaaatggctgacagtggccttttcctcttctgttgtgggatttcccaggccctcattgctgcctttgatgctgttttccatgcaggatggcacgtacgggctgaactgtgctgagcgctgcgactgcagccacgcagatggctgccaccctaccacgggccattgccgctgcctccccggatggtcaggtgagagccaaggaccgctaattgaaaggtgaaacccgccaatttaacacctagtgctgttccttatcacttcacagaaacacacaccagtcaacttttcaaaaaaaatgaaaattcgataaggtttccagtaaactgaaacctttaatctataatccaggactgattttttgttgatttgtgtaggggcagttctcttgagctacaagtaaggtccagctgtcaaaattcaggccagcaagatggggaaaatgtgaattgctttgaagagttcagcaagaccactgtggtatattttgagcactgaagaaagaatgattgaaataaaccctaaaaatatgacaagggtcaccttagtgaggcaaaaaaatacagatattaatatggtgaatatgcatatgcatattattgtatggttaatatgcaaatattaaaatgttcattgctggaagtaaaagttttaaaactttctttttttacgataatgttctggtcatgacaaattcataatatgactgagtacaaattctgtaaccacagggtgggagtttctccttatttatatagcttcaccgtttcagccaggaagtttatcaagctaaaagtgatactgaaagaagaagtttctgctcatggtatacagacttgctaagatatttagtgccaccttccaagtatcatgagcaaaaacattgttcttcttctaggactactttacattcctaccagtaatgtacgagggttccatttttttcatttcctcaccaacactagttattatctgactttttgattctagccatcctagtcagtgttcagtggtatctcattgtggttttgctttccatttccatgatggctgatgatattgaacatctttctgtgcatttattggtcatctctattatcttctttatataaatccctgctcagactctttgttaattttttaactggattttctttttactatggcgttataatctttatattttttagatatatgtccttatcagatatataatttacaaatattttattccattctttgagttattttttcctttcttgatgatgacttttgcagcagaaaagtttttattttgatgaagtctagtttatcttttttatttcattgcttgtgcttttggtgttaaatgtaaaaaaacattgcctgatccaaggtcacaagatttatgtccatgtttctcctaaaaattttatagttttagcttctgtatttagatatttgatccattctgaggtaatttttacatacaatatgaggtaggggtccaacttaattcttttgcgtgtggctatccagttgtcccagcactatttgtgaaaaggctattctttcccccactgaattgtcttgataccctttttaaaattcagcattccataaatgtgagaggatttatttctggactccgtatttcatttcatttgtctatatatctctccttatgccagcaccatacagttttgattattgtagcttaggaggaagcattaaaactgagaaattgaaatccttttaaattggtttttctttttcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagc

SEQ ID NO: 1755 - DNA, 1182 bp, Homo sapiens
ctgaaagaagaagtttctgctcatggtatacagacttgctaagatatttagtgccaccttccaagtatcatgagcaaaaacattgttcttcttctaggactactttacattcctaccagtaatgtacgagggttccatttttttcatttcctcaccaacactagttattatctgactttttgattctagccatcctagtcagtgttcagtggtatctcattgtggttttgctttccatttccatgatggctgatgatattgaacatctttctgtgcatttattggtcatctctattatcttctttatataaatccctgctcagactctttgttaattttttaactggattttctttttactatggcgttataatctttatattttttagatatatgtccttatcagatatataatttacaaatattttattccattctttgagttattttttcctttcttgatgatgacttttgcagcagaaaagtttttattttgatgaagtctagtttatcttttttatttcattgcttgtgcttttggtgttaaatgtaaaaaaacattgcctgatccaaggtcacaagatttatgtccatgtttctcctaaaaattttatagttttagcttctgtatttagatatttgatccattctgaggtaatttttacatacaatatgaggtaggggtccaacttaattcttttgcgtgtggctatccagttgtcccagcactatttgtgaaaaggctattctttcccccactgaattgtcttgataccctttttaaaattcagcattccataaatgtgagaggatttatttctggactccgtatttcatttcatttgtctatatatctctccttatgccagcaccatacagttttgattattgtagcttaggaggaagcattaaaactgagaaattgaaatccttttaaattggtttttctttttcaggattgttttgactattctgggtccttgaatttccatgtgaatggtaacatcaatatgttaatttccacaaagaagcaaggtggaaatttaatggagattgaatctatagatcaatttggggaatactgtccacttaacaatatgaagtcttcagattcataaacatgggatgtcaccagcaacctcttcagtagtgtctctcagccccttggaaaatgttgagagc

SEQ ID NO: 1756 - DNA, 9876 bp, Homo sapiens
aacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgctatggatatttcattgtttttcttttaaatttatttattttaagatgggggtctccctatgttgcctaggctagattcgaactcctgggctcaaacaatcttcctgcctcagtctcccaagtagctgagaatacaggcatgtgccaccacacccagcttgtttttctatttcatttgtttattggtgggagggggtttctacacccagctggatgctgcctggagcccatacacctggtcattggtcagttgtgtggtttttttttgtttttttttttttgtttgtttgttttttgagacagagtcttgctctgtcacccaggctggagtgcaatggcgcgatctcggctcactgcaagctctgcctcccaagttcatgccattctcctgcctcagcctcctgagtagctgggactacaggtgcccgccaccacacccggctaatatttttttgtatttttagtagagatggggtttcaccgtgtgagacaggatggtcttgatggcctgacctcatgatccgcccaccttggcctcccaaagtgctgggattacaggcgtgagccaccgcgcccggccatgttcagatgactgattagcctatcaaaggcattcttccgtttctttatggtggctttgatttctgatctttccttctgattctttgagtctctatttttctgctgatgatgtagggcagatgagcccccaaactgggggttagcccaggagggttcttggctttgctcaggaaagaattcaagaggcagccagcagtaaaagaaattgggtttattgaagcagcagggcacagcagagtggctgccccttgtggagcagggctgactcataggcagtatacccagggtagcagcatataggctgttggctagcagtatttatacccagttttaattacatgcaaattaaggggtgggctattcagacagcactcctcattcaccttccaccatgattgtgaggcctccccagccatgtggaactatgagtccattaaacctctttatgaattaggcagtctcaggtatgtctttattagcagtgtgagacacagttgctccggcctataaatgacacatagttttaagtctgtttcctgcagttctcctatgattggccagggttttgattctgttttgtttttttgcattttcaaattaagggtagatgattctgagggtcttgctccagctctgtctcaggcccccccaccagctatccctctttcttgcagtttacctaacagagccttggggtgggcatgtgtgggaccgtggtgctaagatttaatgctttttctcattttactcatagttatgttgcaattttggcattctctatgtcttaaaggcagtgttgaaggtatagttttgtgtagaagattcataggtgtggagttacttcacagcatttgaaaggggatttggggaggttgcttaccactcactggccattgtttttagttacctggaagtctcctcaccttagtttttggagatactttggctgaatatgttattttattttattttaatttattttttgagacagagtgtcgcccaggctggagtgcagtggcatgatctcagctcactacaacctccacctcccaggttcaaacgatcttgtgccttagccacctgagtagctgggattataggtttgcaccaccatgcctggcaaatttttgtatttttagtaaagttgaggttccatcacgttagccaggctggtcttgaactcctgacctcaggtgatctgcctgcctcagcctcccaaggtgctgggattacaggtgtgagccaccgcgcctggtctggatatgctttaaaggggtcatttctttgtcttctggcctccattgttgctgactaaaagttagcgttattcttaacattattcccctgtaagtaatgtaagtaatgtgttgcttgtcactggctcctcttcagataattatcttgggttttcaacagtttgactctgtgtcttggtgcagtttcctgtgcatttactctgcttggggatccttcagattcttagatacgtgagtcactgtctttcacaaggaagtatttggccattatttcttcataattttttaattgtggtaaaataaacataacatgaaattcactgggtttttttgtttgtttgtttttgttttttgaggcagagtctcgttctgttgcccaagctggagtccagtggtgcaatcttggctcactgcaacctccacatcctgggttcaagcaattctcctgcctcagcctcctgagtagctgggactataggtgcgcaccaccatgcccagctaatatttgtatttttagtagaaatggagtttcaccatgttggccaggatggtcttgatctcttgacctcatgatccacctgcctcggcctcccaaagtgctaggattacatgtgtgagccaccgcgcacagccccattttaatcattttttaggtgtactgttcggtggcattaagtacattgacaatattggctaccaccactatccattttcagatctttctcttcattccaaaaaattatgtacccattaagcaatcactcctcaacacttctatcttcagcccctggtaacttgtaggtagtgtccatgaattttgtcagaagtagaataataaaatacgttgttttgtgtgcgtctgccttatttcattaaaagtaatgttttcaaggcttatccatgttgtagcatgtatcagaatttcattcccttttatggcttaataaattctgttgcatgtatgtgtcacgttttattcattcatctattgatgaacatttgggctgtttctacctcttggctattgtgaatcatactgatattgatgatttttttttcttttttcttgagatgcagtcttgctctgttgcccaggctggagtgcagtggcgcgatctgggctcactgcaacctctgcctcctggattcaagcaattatcctgcctcagcctccaaagtagctgggtactcgccgagtagcctgccaccatgcccggctaatttttgtatttttagtagaaacggagttttaccatgttggtcaggctggtcttgaactcctgacctcaggtgatatgcccgcctcagcctcccaaagtgttgggattacaggtgtgagccactgcgcccagcctgaagacagcattcttagcatgaaggatgcaaagttgaggcaaaggagatctatccaaaccaacctcattacactacggcttctgagccacttctctacctgattaaccaccctagcccacacccttggttttatcccattagcgcagtttacttgtctgtccaattcagtttataagtgtttggctcttaactgcttttctggcttgtttccttatgaggaaccccatgccacataaaactttcattaaacaaatacatgtgtatgctttaatcttgttaacctaatcgtatgtcggtgtaattatcaggcccagcaaggatcctaagatgatgaaggtgaaatcttgttgcccctacaatatggacattggatgcaagtgtctgtgtgagttcctgctttcaattctcaggaattttccgaagttgttttcttcctcattttctccttttgggactccagctgcgccacaggactctgaagttcctgtttcatttttctaatgtgtttgttttccagtttgtatgacttctactgatatatcttaaagttcactaactcttctgtcctcttcatctgtggaatccatttagtgactccttaaaatccagatgtctgaggtccttaggaaaacaggtgcttctccctgttgtagcttgaatttgctctgaatgtggtggtcccctaagccaataacacaatgcctcctggcctgccctggccacccagggaggaatgaagggagaggtaggtgtagtggtaataagccttgctgtgcacagctttgtgtaataactgaaaagggtgatgtgttttcctgctcccatccccaagcctgatttcttcaagatgcagtaactgggacgggtgcagtggctcatgtctgtaatcccagcactttgggaggccaaggagggaggatcacgaggccaagagttcgagatcagcctgaccaacatagtgaaacctcatttctactaaaaatacaaaagttagccgggcgtggtggcgcgtgcctgtagtcccggctactgggaagctgaggcaggacaattgctcgaacccgggaggcagaggttgcagtgagccgagatcacaccactgcactccagcctgagcgaaagagtgagactcggtcaaaaaaaaaaacaaacatgtagtaactgacaccccccacacatgccctcccctccacctcctgttatttcattagaaaccctgccaaggaacaaggaaatcctacaaagaaggtgtctcaggtacccatcagcagccatgcagtgatgacaagtgggtctgatgccattaaaaggttgttttcaaaccaccttctgttgcaagcagaacccaattgcacaggaatccaagctccatgatggagctttggccattgtttttagttaccaggaaggaaaatggcaagattgagattaagcctggaggcccggcggggacctcatggctgtgaagaccctggactcctgtgttgctggagatagtgtttgtgctctcacatggtctgctcagccgtctttctgccattcagcacaacggaaggacctagtgtgtttccagggtgggagcctacgagtggtggactctgactttgacattcgggacagatttattccttaattttcttccttacatacttggttcatctgagggcctcagactccctctccaacagccttctaccctctcccatttccacattttcatttttgagcttccttagctaagtggttttactttcttccctttccatctctctctctctctttatatttctttctctagatttttaaaattctgtctctctcttttctccaatttctccatttccctcttttttttttttttttttttttttttttctttttctaagtcagggcctgactctgtcgcccaggccaagtgcaatggcatgatctcagctcactgcaacctccacttcccaggttcaagggattctcttgcctcaccctccaaagtagctgggattacaggcacacaccaccacacccaggtaattttttgcatttttagtagagacaaggcttcaccatgttggccagactgatctcgaactcctgaccgcaagtgatcctctcccattttggcctcccaaaatgctgggattacaggcgtgagccactgcgcctggccttacattgttattctgcacacattggccattgcgggcatcgttccttacctgagtgaacacatccatgcattcctaatatgtgtgtcctgggaaacctgggtttggagtttggagtttggagtagagaggccaagggtttgcagtcaggcaggttacttgcaaaatatttacgtatcagtcagatacattggctcatgcttgtaatcccagcagtttgggaggctgaggctgggggatcacatgaggtcaggagttggagaccagcctggacaacatggtgaaatcccgtctctactaaaagtacaaaaaaattagctgggcatggtggtgcatatctgtattcccagctacctgggaggctgaggcaggagaatcacgtgaaccagggaggcggaggttgcagtgagccgagattttgccactgcactccagccttggtgacacagcgagactgtgtctcaaaaaaaaacaaaaacaaaacaaaaaaaaattatatatatatatatatatatatatattatgtattgtgctaagtttcttctttgtaaaagcccttgggggactgttaagtgtgtgtctcagcttggatttgggtttttttagaccagagatccctggtccctttggaggtgtgagtatgagggtatttgtgtctcttgagaaggtctaagagttgccatcagtttggtggcagggtatgttgtacttagagatcttgtcagaatggataactcattttacctccatcacttacgaaatgacttttatcagctacattaaaatgctagcaatgtcatactacattctcataaatactgggaattaactaatgactttcttgtccaggtatttataggctttggcaaggcagcagtacacaaaactggtcccattcatagtaatcttgacgttaaactttggagccagagtacaagcgaataaataaacactaggaagaaaagtaaatgcggagaagaataaatgctgtgaggaagagtaaagttgaggaggggaacagacagatgggattgacccgttcaacctgtgcagtgtacagcgtatactcttttttttttgagatggagtctcgctctgtcgccaggctggactgcagtggcggcgatctcggctcactgcaacctctgcctcccgggttcaagcggttcgcctgtctcagcctcccagatagctgggactacaggcacctgccaccacgccctgctaatttttttgtattttagtagagacaggggcgtacactcatttttggccactttacctttttaggaaacaaaatcatcacagaaatcctcaagaggcagctttcctgtacatttcagtttctcctaaaacagaacagggctgggaatgcttactgaggaatcatcaaagcatttctttctgtcatgacaagagcaattccagcttgctccatgagaccctgcttctctcactgtatttggttttcaggttgcaagatttgaagaacacttgtcaaaactcgacggttatttctgttttcaaggactgtttgatctgcattttcttccagtccattcatttctatctggtttggcctccaaggtcttaatcttttgcccaagaaaacgcttacatttaagcaacatgagttccttgatttgtctgtagcccaatgctactttcttgagttcagaataaaagctgattattattattatttattgttattattattttgagacagagtcttgctctgtcacccaggctggagtgcaatggtacgatctcggttcagtgttacctctgcctcccaggctcaagcaattcttctgccttagcctcaggagtagctgaggttacaggtacccaccaccatgcctgacaaatttttgtatttttactagacagaattttgccatgttggccaggttggtcttgaactcctggcctcaagtgatctgcccacctcggcctcccaaagtgctgggattacaccagccttgggacttgacagtttttttttttttttttaagatggagtttcgcccttgttgcccaggctggagtgcactggcgcgatcttggctcaccataacctctgcctcccaggttcaagtgattctcctgcctcagccttcctgagtagctgggattacaggcatgtgccaccatgcccggctaattttgtatttttagtagagacggggggtctctccatgttggtcaggctggtctcgaactcccaacctcaggtgatccgcctgcctcggcctcccaaagtgctgggattacaggcgtgagccaccatgctgggcccttgacagttattttgacctaacattggtgataatttttctctacctcaaccaagaagatggcggattggagcacttttttcatagattgaccagtcttcccaacaacactggaggccagtcatttactttctgcagagaaagagacatgtcaaagagtcaacttaccagctggaaactgggactagtgtcaagtgcttactctgacattcagctcttgtttcacctcttgacccctttcatgcctgcatcaaccagtggatctgctgggctcagagcacatgacaaaggggcttgtggtgttccacttggcttcctgaaatcccttcctttcccctggcagtgcttccacgcaggactttgagtgtgtagtcggggcagtttacatccccaagtgaaaatgctgaacgttcagcaagccttggtcaaaagttttcctaggctcactagtgaagaaatagcaattactcactggctattgccaggattgagaaaaagaatgtgtaccctagaggccgggcccaaggggaagagagtactttctctcagcattgagtaaaatcggccattttttaaatgagccttgggaaccagcataactggtccctttgtgcccaatttctccatcccgataatgaattccatggataacctcagtggcccatgacagttgcctctcattgcacttccctgccagttctcagaaagaaagtgtcacacagtctctggagggaacttctaattacaggaacacagtctgcttgtctgagtcttgttttcagttcttggaccctctccagcagggaaaatctctgtcttgtgtaacctttgggtaacatccaatccactcaggaattcttccctgctagggaacctattgtatatacccaatgaatattagctaagtgccttacacttttaattaggttttgggaagaaagatcaataagacaaagtactgcccttaagaaagtaaaggtctaggagaagagcgatattaacagtaaataagacacctagtatggcaggtgaatccatttgggaggccccagatgaggaagatgttgaactgggggccatcaagaaaatctaagtagaagagatgatgcaagctcagtgtagaaggatgattatgattgtgattatgattatttggagatggagtctcgctctgttgcccaggctggagtgcagtggcgcgatctcagctcactgcaacttccgcctcccgggttcaagcggttctcctgcctcagcctcccgagtagcagggactacaggcacacgctgccatgcctggctaattttttgtattttagtagagacaggttttaccgtgttctcaggccagtctcaaactcctgagctcaggcaatctgcccacctcggcctcccaaagtgctaggattacaggcatgagccaccgaggcctgccttgtagaaggctcattaagagttcaggagcagaatcaaataagcatgctaatcctgagtgcaaaggcactgaaaaaatgacagtatattacattctgtagataaaagacaatctttggagtaagaggcagacttgaaaggtaatatgggacagattggagaacacacacatttcctttattctctctctttttttaaagactcggtctcattctgtcacccagattggagtgcagtggcatgaccatagctttctgcagcctcaacctcctgggtttaagccatctgccaacctcagcctcttaagtacctggactataggcacacactaccatgcctgactaattctattttttttatttttgtagagacacagtcttgttatgttgcccaggctagtctcaaactcctgggctcaagcaatcctcctgcctcagcctaccaaagtgctgggattacagtcatgagccactgtgcctggctcacacacatatatctatatgttagtctactagtttcaatgtaaatgttagt

SEQ ID NO: 1757 - DNA, 18520 bp, Homo sapiens
tttgtgatttttgtgtctctttaagttgtcatgccttacataaaaaaggccctttcttccttcataggtctttttcagctcaggaaagttttttctcctatttatttttaaaattatttttctttcaaatactctgttcttttcttcaggaacaactatttgtctatctatctatctatctatgtatctatcttcttgtctctttttcagagactccaaatatccacacagtggactctattctttattctccatatatcatctttttatgatttccaattttttaactaaaataacctctcaaatctattctctacaccgactaaactttgtacaacgacatcaattctatttgttactgcctcaaatatagatttttaatgcttttgtgataggcaaaataatgttcccccaatccaaaaatgttcaagtcctaattcccataacctacaaataagttaccttagattgcagaagggactttgcagacatgattcaatgaagaacctcaaaatggacagattgtcctgaattatctggatgtgtcttcaaaagtagataacccttccagatgtggtcaggagacatgacaacaaaataagtcagattgctgcaatgttgctggctttgacgttggaagaaggaggccataagccaaggaatgtgagcagcctccagaaactacaaaagacaaggaaaccaaccatctctcctagagcctccagaaaggaatgcagccctgtcccgaccttgatttcagcccaaagtgacctatatcagacttctgaaccacagaactgtcagatactaaatttgtgttattttaagtcactaaatgtggggtaatgtgttataagaggaacaaaactgatacggctctcatattttcagtttctcatcattttgttttctcttactatcttctctctgacacttcatcactgtctgttatttttacatgaagttctcctatccatagaagccatgtattcttgaatgtgttggacggcaaataactccccgaaatgttcttccttccttagcttaaaattatttttagagattcataggtatgcctctgagttttctactgataacctctgccttgattttgtaggatgtcttgtttcacttgatttattttcaaatgttaatttatccagaatattttagcactgaaaaaactgtatagataatttctacataagccagtgttttccatttatcgataaaggggacggtgttgaggggaggcagaaaatgaactccctaggaatgcagacaaagcagaatcggaaactgggaggttctttttaaaactgtaccttcccatcctgaaaaaaaaaatctgatatacctcctctgcccagagagattcagtactatatactgagtcactgtgaatgacggcaacgtattataatgctcaagcatgttgttcaaaaaaaagaaaaatcttcaaccttttccacatagataattaacttgactggaaagttattaatacccaacaaaggatatttctacctacagagctaagtctaaaactttcaatacagtgcaccttccacctgctataggtaataaactataatccacaattaggactttgccacaggtatccatatagttcattattccataccctgcaatatttgaatattttaacattcaaagtatgtaaaacaaatgttatttggattaacctatctttcttttgtcattgtcaaacttttaaattgttcaatacaattggtctgttatttttgcaactacgtcactaaataatactactacagaagaactaagctagtttatgctgttgtcattctccacttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatccctaaagaagttgaacaaaaacagggtccatttaggcttaaaattgtgcatttttctgaggagcaagtcaatagctttccttggtttctcaaagtggtaaatgacaccaaaaaggttagtcatcctcgcattaaaaggtaatgtttcccaatcttttcaggtatatatatatatctatatatatatatatatctagtgatattaaagaggaaaaggtgtcattcaagacattacaggttctacctaaccagaaccaacacagaatcaataatgaatagatgagttaatttcttccccatttctaaataaccctaagattaaaaaaaaaaaaaatcacaagggaaatttgaaaatacttaaagctgaatggcaatacttatacgtgtttataaatttggatcatatacacaaaaagattaaaagtgtaatcaataatgctttacatttgtgtggatcattactttaatgatactttcacaaccaattattcctccttttttaggaaggaagggcatatcctagagtctccaatttacagataacgaaacaattattgcccaaggacaaacatttcttaaccatgccagtttcctgacttgtaggccaatgctcctcccaatgttaacaagcagcacaagcttccttcctgggggtttgcactgtaaacctgccagaggaaaataaaagatttttacctcttttgttttttctctctggaatgtttgttgtgctgaatcattaggagacagagtatatgagcaaacaaaggcagatttaaaatggttatctgaggttaccatctcacaccatacttgttgatcattaagtatgagccgagtgaagcaaaaacagctctacaggtttagcacacctctccacagtagagaatgaaagggagattatacattggggctcctctagcaataaattgcttcaacttcttcaggaggcttattaagctcaaacaagcagcagagaactccaagtagaagaaacctaatctccaatccccttttcctagtcatccacgcggacaccaacatctgatggattcaggaatacaccaagctccaagaaaaatacccccgccccacaacctcaccaccaccgataaagccacctaatcctgtctgaatctcttctctgcaaatgttttggtatgcaaatactcgttcattaataagaggaagcaggaaaaagagtgaagaggagtaccatgggaaagggggccccaaaagggaacggcagaacccagagagctgcactgacaagtaagcgaccgcgagtaatcggtcagcacaaaggagccaatcccgagccgcgtggaagaccttgggaggtgggcgggactaacgtgtccagggcccagcggctggcgccagacacgctggcagggcgggaaccgcgcgttccttagcaaccgcaatggccacgcccaccgaacccagcaccctccatcccccatcccgcagccagcgccctactcaacgggaacgggtccttcagtgatcaccgtacctactgggtttcccggactccgggtttctcttgcagagcctccctccgcccagccccaccaagtgccgctcccagggacggaacgatcgtctcccaaacgctttagggctcgctaaagaggtgcgcccgctttcattcccggaccccgagcttcccgggcagggtctccccaatcccctcgcactcgccggacacacacctcagctctgccaaggcaagggccgacaaacttcgtgtcctgtgggaaatgttgctgtccacggttctgtcactcaggggcaggggcgggacaagccagccgcacacccctactcccaaagggtgaggcggaaaagaggcgaggctctgcccccaggggcgggaccaggcctcagcctgctctcggattggtcggcctttctcccgtctgtacgccggtccaggacgcaaaggcgctggccctgaggcctttccctcattttgatgccactccggagttctaatacctgtctcacgaggtgactgtagaaattaaaaataaagactgtgacttgtttagttaatataaaacggaaaaatatgttattttgattattgaaccctcccatctcacacacacacactccccaattcacaggatcatccctaaggagcgtccctaagtggaagggcgcactgtctgtgtaaacaatcaattaattgcccattcaaacagcaaaaaagaaaaaaaaatcgttttatattaacattaaccagagattaataaatttaggaaagattgcaaaaacgtgactgacaattaggatttaggagcctatgttcgggtactcaattttcacatctacaaaatgggaatgaaatattaagatgttacttattggaaaagtattcaaatattaaatgctttataaattatactcatgtaatccttacaaaacccactaagagtattatccacagcctatggacaatgaaacacaggctaggaaaggctagatttattcaaccattcaacaaatctaagtgcctgcagccatcattttttaatattgtggtgaactaaatctaaaattccttcaaaaaattatgcaacctccaatttaatttttctcttgctcacataaaagtcaccttcctctaggccagccccatcatatctttttccaaaagcccttgagaaagaaagtagcatacaaaaaaaaaaaaaaaaaaaaaactgagacaagtataaatagactaaccagaaggctttctgaaatctcacagaatattatggccaggaattgaatccaaaatgtaattttattttccgtcctcctaaatcattttctggtctccagttcctctcccagaaataaaggtagagttaaatgagattatattaatacacttaaccagattacttatgtgtgtggctttaaaatagtgaaactctttttccttccatattaaaccaaaacccagaagggtttatcttgtctgatagatacggttgtagtaagaaaaaagaaaaaaaaaaagagtacctctggacaagtgccttgagattcaattaaaatgttcatcgtactgtgatgcaattgttggaataaaagaaacccattccaattacaaataattttacactcttgacctgctgaatatccaaattcttctgaaagcttgctaaatgtgaataactctctataaaactttcttgatttgtatgactcagagtccccattttctttaatcttttaaaaatatttggtttggccaggtgtggtggttcatgcctgtaatcccagcactttgggaagctgaggtggacggattgcctgaggtcaggagttccagaccagcctggccaacatggtgaaaccccgtctctactaaaaatacaaaaattaggcaggcatggtggcaggcacctgtaatcccagctactcaggagcctgaggcaggagaattgcttgagcccgggaggcagaggttgcagtgagccgagattgcatcattgcactccagcctgggcaactgagtgggactccatctcaaaaaaaaaaaaaaaaaaaaattagttttagactaaaaagaaagagttatgattatatattaataaatatataaataaatgctgtaagatttaaataaaagtggtgaatgtacttgagtccattttcattacataaagatgtacagcaatgcatttgtacagcaaatgcattgaatattctcacatatgtaagatattatacaacaagaagtaaatagcttaatgtaaaattaaaacttccagatgtatgttatatgcttatttctttaccatataaagacatatattattgacttacatttctagcaaattgaaatataattggctgcatagtattctatggtgtatatgtgccacattttctttatccagtctattattgatgggcatttgggttggttccaagtctttgctattgtgaatagtgctgcaataaacatacgttggcatgtgtctttatagtagcatgatttataatcctttgggcatatacccagtaatggaattcctgggtcaaatggcgtttctggttctagatccttgaggaatcaccacactgtcttctacaatggttgaactaattgacactcccaccaacagtgtaaaagcattcctatttctccacatcctctccagcatctgttgtttcctgcctttttaatgatcaccattctaactagcatgagatggtatctcattgtggttttgatttgcatttctgtaatgaccagtgataatgagctttttttatatgcttattggacgcataaatgtattcttttgaaaagtgtctgttcatatccttcacccactttttgatgcggttgtttgtttttttcttgtaaatttgtttaagttccttgtagattctggatattagccctttgtcagatggatagattgcaaaaggtttctcccattctgtaggttgcctgtttactctaatgataatttcttcagctatacagaagctcttcagtttaattagatcccatttgtcaattttggcttttgttgcaactgcttttggaattttagttataagtctctgcccatgcttatgtcccgaatgatattgcctaggttttcttctagggattttatggttttaggtcttacgtttaagtctttcattcatcttgagttaatatttatataaggtataaggaaggggtccagtttcagtttcctgcatatagctagccagttttcccaacaccatttattaaatagggaatcctttccccattgcttgtttttgtcaggtttgtcaaagatcagatggttgtaggtgtgtggtgttatttgtgaggcctcagttctgttccactggtctatatatctgttttggtaccagtaccatgctgttttggttactgtagtatagattgaagtcaggtaacatgatgcccctctttgttctttttgcttaggattttcttggctatatgggctcttttttggttacatatttagaattatgtttctgtgtttccaagtatttgagagttgtctaatatcttacagttattgacttttaattccattgtagttagaaaatatatattgtaatatttcaaattttattgaaaattattgacacatatattataacccaacatatggtttatctttatgactgttctcagtgtatttggaaaaaaaatgtgtattctgaaattatggaatgcagtatgctctaaatgttgattatagtctatatcttatgacagttttttttttttgcttttaaaaacattttatttatttattttattttttcattttactttaagttctaggatacatgtgcagaatgtgcagatttgttacttaggtatacatatgccatagtgatccttaccaacatttttaagcatattctatcacttattgaaagaaaggtgttaaatctccaactatgcttgtgcatttgtttatattttctttttttaaaaaaaattaattttttttaaattttaggttccaggatacatttgcagaatatgtgggtttgttacacaggtaaacttgtgccatgctggtttgctgcacctatcaacccatcccttagatattaagcccagcatgcattagttatttatcctgatgctctccctctccaaatcctcccctagcaggtccctgtgtatgttgttcccctccctgtgtccatgtgttctcattgttcagctcccacttataagtgagaatattcagtgtttggttttctgttcttacattagtttgccgagggtaatggcttctggctccattcacgttcctgcaaaggacatgatctcattcctttttatggctgcatagtattccatggtgtatatgtaccacattttctttatccagtctatcattgatgggcatttgggttgattctatgtctttgctatggtgcatagtgctgcaatgaacatgcgcatgcatgtatctttataatagaatgatttgtattcctttgggtatataccaagcaatgggattgctgagtggaatggtggttctgcagttctgcttctaggtctttaaggaattgccacactgtcttccacaatggttgaactaatttacatttccaccaacagtgtaaaagtgttcctatttctccacagtctcaccagcatctgttgtttcttgactttttaataattgccattctgactggtgtgaaatggtatctcattataggttttgtttgcatttctctaatgatcagtgatgttgaactttttttcatatgtttcttggccacatagatgtcttcttttgagatgtccctgttcgtgtcttttgcccactttttaatggggttgtttttctcttgtaaatctgtttaagttccctgtagattgtagatattagacctttgtcagatggatagactgcaaaaattgtctcccattctgtaggttatcttttcactcatgatagtttcttttgctatgcagaagctctttagtttaattaggtctcatttttcaatttttgcttttgttgcaattgcttttgatcttttgtcatgaaatctttgcccatgtctatgtcctgaatggtactgcctagattttcttctagggtttttatagttttgggttttacatttaagtctttaatgcatcttgaattattttttgtataaggtataaggtcggggtctagtttcagttttctacatatggctagtcagtttttccagcgctgtttattaaatagggaatcctttccccattgcttgtttttttcctgtttgtcaaaaatcagatggttgtagatgtgtggtcttatttctgagttctctatctgttccattggtctatgtgtctgtttttgtaccaacaccgtgcttctttggttactgtagccttgtagtatagtttaaagttacacacacaagggaacaagacaaggatgccctctctcaccactcctgttcagcatggtattggaagatatggcctgggcaatcaggcaaaagaaaaaaataaagggtattcaaataggaagagagaagtcaaactgtctctgtttgcagatgacatgatcctgtagctagaaaaccccattgtctcagcccaaaagcttcttaagctgctaaacaacatcagaaaagtctcaggatacaacatcaatgtgcaaaaatcacaagcaattttatacaccaacaatagacaagcagaaagctaaatcatgaatgaacttccattcacaattgctacgaagagaataaaatacctagatatacagctaacaagggatgtgaaggacctcttcaaggagaactacaaaccactgctcaaggaaatcagagaggacacaaacaaatggaaaaacattctccatgctcatgaataggaaatatcaatatcctgaaaatggccatattgcccaaagtaatttacaaactcaatgctattcctattaaactaccatcgacagtcttcacagaattagagaaaactactgtaaagtttatatggaaccaaaaaagagctcatatagccaagacaatcctaaataaaaagaacagagctagaggcatcacggtatccaacttcaaactatattttctttagttgtgttaattctttcattatatattttgaaggtctgttactaggctcatacacatctagaattattatgatttcctgatgaatcaacacttttatcattatgcaatgttgacctttttatctctggttatacttggtggtgaagaatatttgcctgatattaataatcttagattagatgtattatgcctgttgtttctactagatccatttccttgcctttacatttaagctatctatgcctttatagctctatctcttgtatacaatatattgttgaatttgcattttttccagtctgacaatctttgatttgttataaaaatatttattcaatttccatgtaacatagttattaatatgaagggtataagtctatcatttttctttgtattttttatttttcatttttacctttctcctccatttatactttcctttttttatttgctttagtcaaaaatgtttagacttccagtttgtgcttctaatggttctttagctatattctttttgttattttatttgtggttattctagaggtaacaatctatattgttatgctgagaatcatcaatgttgcattcatttaatattatgttctaagagtagtgccctgtgctcctccttcacaccaccccccagttttctgcctagctccaactttctacttgctttggcattatgccatttggcatgtccccatccaggagggtaacaacactatctttcacacccgggccaagaacacaggaaagtgaagtagaagagtggataaggccaatcccactaagtagaaggctaagcagtgctgagcccttaacaaaagccacaacttccagctgatctttactgtgtttcaagacctgtcactcagggccagcttcacggtatgagaactgtacaggcccacaacacccatggtcagaaggttcccctgtttgtttaatgatctactattgctgtcctgaaatttttaataattttatctttgaacttattttttgtaagttcagtctaatgggataatgaagcgtgtgcatgagcagaagagatattcacagtaagttctctactatttcttgtgatctcacttgcacatagagttcatggtgcctcgtgagcacagaattctgatggacccatcataggtgagagttcggcgagactcaaagcaaatgtgaggtaagcctgttatcaaagtcatttgttttgtttccattgagtattggtagaatgtgtgcatatcaagaaatgaaataagaacaattttgagttggtattttttgcagtttctactggttcagtaacaacaatatacatatgcatatatgagctatgaaatatgaactatgtaatttcagtgattctggatatcagtaaatgttcttatatttttgtttagaactgcaattgcacaaaatgaaggtgaacagtagcaatcacacttatgatgaaaaattttaatttctctacttagagcagcgttaaatagcaagtataaaacaccacgataacttcagagagactttggaagaaagcaataaaacgttttctgtcttatgcctttgatggcacattttacttttttttaaatttttttaaacaacgggccacacactttcattttgtcctgggctaaacaaattatttagcttgcactgatatcatttcactattaaaagatatacaaaggttgactttggtgatccagcttctgcagagtcaagattagtaaggataaaatttttggtgcaaagtgggagtaaggaaaacattagtaaggataacatttttggtgcaaagtgggagaaggagaaggaatagctcgggaggatgctaccaaatttgagccgcacagtacattccggtctagtacattctcgtcccctatagtactctgttctttacagaaggaggagtttaaatgatcaccactgtatgtgagtctgggaccccttatctgaaactgcaccactttggtatatttacgttgtgaaatcactagctttgggtaactgcttcctccatatcctgctgctggctgcaaacctgccctgtgcagacaacccatttcttctgcctgatctgctcaatagctccacatcaagtgcttgaaggtcaagttacatttcaggctggtatccctgtgccatcaacagcagcaacctacatggttgtcaccttgtcaacagttagctggaggccacatcagagaagtggagctctttggccaggaaagcctgaaacaggtgcacttccctgacagcaaggacatacccagtaacaaacagcacttctacatctactagctgctggacatcctggactatgggctcagcttccagctgcagggccagaacttgtatatcatccaactacgacagcacaaagtcttccggagtgagccttgtaccttatccaacagctcccacctcaaaccaatccaacagaaaatgaagtccaagctcttcagtctgaatctttttcaatgagctcatctcattccaaaagggccaaaccaacacacaaccacgatttgtgacctccttttttagggaagggtatcttgactataagtcctgaaacaagaaattcattattctatagatggtgtatggagactgaagcttggttgttgctgaagttcttctcaggaggggttcttaattgactgatagtatctagacatacatctcaaagactgaaccataaggtagaaaagttgaaggagctccatcacatccagcaatctcatcaattgcagactgtaatccaggctttcctgagcccaaccttgatgctggccagtggccctgactcattcacccacttgacccataatactgaagctgaagaaagcaactagcccagtcttcctagagggctttgtaaatggatgtggaggttccatggaacccatgggcaccttaccagttttagccttatgtcttctgcagggccttgcctgggaccaagaattggattttaatcaaaagaagaaagaagacagaaataactagctatttttttccacagaagctgaggagagagctgaaagacagctttggtttcagggttccattctcctctgaatctacctctactgtcctatttctggcaggcctggctctcagggatgctcaccttctgctcatgttccaaggaactcccacaatcaaggatacctggttgcttaaggtgtattgcccccagggggcctgctctcatggcctccccagtttccacaggctggaggagccagggtttgattttggtcccagagatatgctggtctcatagaaaaagtttgaaagtattcacttttcttcattgtctagaagaatttgtgtgcattgccagtgttactttcttaatttttgtgtagaaatctccgaggaagccaccaaagcctagactttttgtgggagaatttttaatacaaatacaatttttaaagtagatgtgggactattcaaactctctacttctttagtgaccattagtagtttgtatactgcaaagaatttgaacacattatatacactggcaaatttattgagataaacttgttcataatattgcttatattcatttttatttctgtagaattgtggtgacctcacttctcatatttctggtagtggcagtttgtcttatttttctgatctccttggctagagctttaattttattacctttcttaaagaagcagcttttatttttatttttttctattgcttttcagattcttattttattgatttccatttttatctttatttcatttttctgctaactttggatttaatttgctcttcttgttttagttactttagatagagattgaagccattgattagagtattttctgtcttttctaatataggagataaataatataaattcccctccaatccatacttaagcttcatcccatgaatttgaacatttttaaattttcatttatttaaaaaaacttctcatttcattttgatttctgatatgactaatgggttacttagaatatgttatttactttccaaatatttggagattatccagataatttcctgttagtaatttactatttaattctgttgcggttagagaatatactttctatgattttcattacttaagatgtatagaaacttattttattatataggttttcttggtaaatatcccatgtacacttgaaaagaatgcacattctgctttacttcaatagcattctataaatttcagttatgtctagttggttaatagagttgttcagattttgtatatctctactgattatgtctacttgttttaataattacttgagaaaggtgtttaactctcctactataattatgaatttgtgcatttcttcttgaagttttatcagttttcatgtattttaaagctttgtcattatgtgcatatgttatatcctctaagattaactgactccttcatcattatgaaatgacatttttcatccctggtaatgttctttgctctgaaatctactttgtgtgatattaatataatcatgtcagctttcttttggtcagtgttaacatggttttattttccagtcttttaaccaatttgtgtctttatattttcaagtgttctcttttttgtagacaacatgtagttgagtcttgttttttaaaatctaatttgactacatctgccttgtaattgaggtgttagaccatttatgttactgtgattgctgatataattgggtttaaatgcaccatcttgctgtttattttctatacgttcaatcccttctttgttctcttttcttttgctttctattttggaattatagaatacttttatgattctatttaatttcctttgctgacttcatagctgtaactttttaatggtttttttgtggcttataatatagctgtttaacttaccaccatctacctttaagaaatattatattatttcacatatagttaaagaagcttgatgcagtatatttccatttctacagtctttgtgctattgtcatgtattttatctctctatatatattaaacccaacaatacatgtgattatttttgctgtaacaattcaatattcttttaaagagatttttaaaatgtgaaaaaatgtatatttacccacatatttaccatttccagtgctctttgttcctttgtgtggatccatgttgccatctggtattattttctctttacttaaaagactttcttgagcattttgtatgaagtgtgctttctggtgatgaagtctttcaccttttgtatgtctaaataagtctttatgtttcatttatttttgaatgatatttttgctgggtatataattctaagtcaacagttttcatttcagtactttaatgacgttcactactttaaagggacttcaaatacatatgcattaggctacttggtatgttcatacttttctctttttttctctctgtatataatttcaaatcgatttttttgcttcatagctatatattcaagttcgctcatattttccaatattaattccatctagtacatttttaatcagacatttttccctatatttggaagtttaaattggtactttttaataccatctgtatctttccttaacatacttatccttttctctaccctcctgatcattgggaagatagttataactgcttatcatccttttctactaactatattatctaaattacttcttactctattactattgattgaaatttgttttcattatgtggagcatattttcttatttgttttcacacctgggcatttttttattgaatgctagacatttttaattttaccttgttgggttctggatatttttgtgtgttcatacaaatattcttgagctttcttttgaagtacaattgtcatgtagaaacagtgtaatccttttgagatttaagttttgttaggcagaaacagagaagcatttagtctctgaattttgtcttactattgacctagttatagccattgctcttggaactatgttgtatttccatttttgctggaataaatacaaactatttctgaccatgtgttggtcttatggatttttctctctgctttttccaggtgattcatttctcaaatgcagattatttcctcatattcattcatcaatcagtactcagttgaattttcaagaggaatgcattgtatctatccagagctcttactctgtagttgtctcctgtctgacacctttccctgtgaattgtagctgctttgactttgccagactcccaactacatcttcttaactcaggcacaccaccaggctctacctgggtctcctctccatgtgctgtggcctggaaactttggctctaatcacaggcattcatagcccttatgcatttgtttactccctctttgggatttttgtcccatgatacttgatgcccagtgcctgaaaaccattgtttaatagatgttgtccaaattttcagtgatttcagctgaagtttaaatccaatttctgttagttcatcatggctgggagcagaagttttgagccgctcaatttgtattcaaaaattatttatcgtaatttggggggtctaggaggatgtttcatttgtaaccagaggatttgtactgccactataag

SEQ ID NO: 1758 - DNA, 2421 bp, Homo sapiens
acttcagtggcttaaaagtcatgtgactgacaagagtctttcattaatggaactgtctttgccttttgagtcaaaaaaactgttaaaccactgaatatggagtatttacctttttattgtttaacatttcaaaattacgaattaagtaggaatcatttatttttcatggaaacatacacctatctcactctattgttgcaaagatgctgaacatttctaccatataaaaaaggtataaatatatataatggtatgaaaaattagctctaggcctacatgatccttatctgtttaataggaaatttgagaatatcaaatatgatcaaatatgtatcactattttccattagtattattttagtcactctggatgaataccaaaaaaccacaaaattctaagtaatattgtttaagacattaacactttgagtcaaatctactgatatcaaaaacacagatacatatgcacaaagattaaggagaaagctggctgagtttcgcgtttctacatagaagaatgtccactggagcagggactctcaaaagatgctttggcattggagtgagacaaagaaattctttattgagctgatagatctctacattacacaatatttatcatctctgaacttcaggatcccaaaagccagtagtacttcctttaaagaaattagaataattttaaaacaccctggcatatttcaaataccccagaggtgtcacccagaatggaaaaccattctggaaatggaaaaccagagcactagattaacagtcctggcctcagatcccacttcttcttcacagcttaccaaaaagagacgtatctgaccggttcacattactccaccggtagagctaacccattataaaccactaagcactggagattttccatcttttattagacctctgccctacaccatgaaaagcagtaattgtaagtaagcgtatctgttccgcaatctgaaatttttctctcagctgaactaaagtctaggttctgggaaagagagtaggagtaaaaggggataggaagtactagtactcatttttggtctcatttttgcataaagcactatccccactcgacttgttattgcaagttgaagttgatatggcaggcgccacatgtctgtttacaaacgcaagagaggaaggaaagagctattattgagcccctaaaaatctctaaatccattgtaatgctctctctaagccatttgtctttatccctgtttctctaccagaaatgaacagagttgaataaagaaagagtcaagtaccaaacagttcaaataaaattacaagtactaacgaaataacaggtgcatatatacatttatgcgttttacaaaagcaatagctctttacctcttcaagtttttccttatccaataacaactttttatatctactactgatatccacttttattgataaagctagatagggaatcagaccaaagaaaataatgaactctatttacagatttctatatgaatatagaaatcaggaaaagagccacagtgaaaacaaccacaattctttttagccacaaattaaaatgttataaaagattattcacttaagtttaaaaaaaaaaaaacagttctaagtatcaagtaatgatattccagtggcatgtactaaaaataatcagcttttctttgtccaaaacggacctcgatagatgagaaagtttatggatttaatgttcatctcaaaagtacaattttggccagacgcggtggctcacccctgtaatctcaacactttgggaggccgaggcgggcggatcacctgaggttgggagttcgagaccagcctgaccaacatgaagaaaccccgtctgtactaaaaatacaaaattagccaggtgtggtggtgcactcctgtaatcccagctactcgggaggctgaggcaggagaattgcttgaaccaggaaggcagaggttgtggtgagctgagatagcgccattgcactccagcctgggcaacaagagtgaaactccgtctcaaaaaaaaaaaaaaaatacagtttcacatttttctcaaaatatttgacaatgttctttttacttgtttaaataccagaatatgctttaagaggttatgatcaaagggcatttgggataaaacatagattacatggttttgtaagatagcaacaaataactgaacattagtagttcccgtttgttagtgctcaaaaaaacaaaaaagtacaatgggaaagggggccccaaaagggaactgcagatgactgaaggccttgaacaaaggtatgttatggtaagaggcactgtggaagaaaggcaaaagccccactctgctcccagctatgtagccttgggtaaaagttacttagtctctctgtaggatgaggcaagtgggagagaataatttccttatcccta

SEQ ID NO: 1759 - DNA, 5782 bp, Homo sapiens
gggtgaggactcatttactttcagaaaacaaatcatacagggtttatctgttacagtcaataacaagcaaataactcagaaccatcagcttagaacttagtcattcgtctagcacgtccttctgatcttgggggctgccggattcacgctgtcaaacaggacactgtttgcactgatggaaatcgctcatcagcagccgagttctttaatgcactgacgcaaacagcatctgcctctacatattctgattttatggtctccaattcttcacttaaaaaaggaaaggagctagaaggaggttctgaagtctgcatgacttaaaaggaaaggacgtgagtgtccttcacaaaggcgcagctgtctccacagccccgtgtcctcagccccaggcagagcagagacaggatgaccattcaggcgccctccatggtcactagggaggtcatgcggcctgggacaactatgtttagatttatttaaggttctatttacactggtcgcatattactgaatacactgtgtgggggtgggggcggagatatgccaggtgaaaggagtccctgcttgttcagtggcgtagccaccattgcagagcctgcagtggccaaactgggggaccaaatgtaaggggagagcgcagcgtttccagctgtgttgtctgcactcagcctcccctccccggtggggcgcctctttccctttgcatcccctctccctgggcagctgccctggctctgccccccaacccctggcaccagcccttgttgccagcccgagccttcttgctgagggtccctgccttcctgtggggttgaaggcgtggctggcctgggctctgctaaccttagagtgggctcctgccttggagcatggggctaacatgggtgagggtctcagccaggggtgtggacaggagggtggctgctgagagtgcacacttcagccagctctaccaacggtcctgccaccagtgccctgcacacgcacagtcactgataaggtgtctgccatcctttcctgcctgcatttctcctccatcaggcccctgcagggggtaaagggaaccccagcagggaaagaccctgtgctcagcccccactccaacagtgggtgtgggaccctcccccagagtcctcatccctggcacagcagcagctgcctgcgcaggccatggggacagagatggggacagcaagccccatgcacgcctaggccatcatgggcatcataggcatcgtgtgtctgggcacgctacatccggcaccttccaccacatttggaaaatacttctgcattcaccttcctaaccgtcctgcttcatttcccgtcatttgcaagagaaacacacaaagcaatgcacttaccctgcccggcagggcttcctatcccttggagatcccaccgtgtgttgtgcagggaggaaggacactgtcccttcatagcagtggtgggagaggaaggtctttaaacctgggaacagagtgcagtgaagaaaaaacatccacaagggtcattgcttggttaggatgctgtgctgggcagcttcagaaatgtcgctgagcgcgcatctgcctaaaccgtctgcaggagggagaggccgggcctgcttcaggccatgtcaccattgaaggcagtggcagggtctctgccctccctcaggacaacagcacgtctagtcatagtgctggtgccttctgacacccagtgatgctgggacagccagggctatggccactcttgacgctggcaaagtggggcctttgccattagccacccctcatagcctcgatgatgtggcctgtgggctccagtggctcagggtcatcccctccacctcttcatgagggtcagtgatgcccccacctgcctcagggcttggcccccactggggtcagccacagcccctgtgacgtcctgaacagctcaggacagaggccagggccgctgccacccaaagtctggggccaccctccaggcaaacgtgtgcgctgtccacggggctgccagcagcctggcacccgggctgtctgggaaacaccacccagcaggacagcagggactgggcaggaggcaggagaggggccccagggtgtcgtgggccacaccaggagccaggccgtgtcctgtgagtctcagggcgacttcactcctccgtgtctgatgctggggctggtgctgccctgtatgacatctggtgtggcagtgacggcctgcagggccgtcacacacaaccttacccccgacacacagaggcctcacatcctcatccgcagatggcaagcccacagccaagtgtgcaccgcccaggggtgggggaagctgccggcaagagcagtctggctcctaggacatctgtgtgcctgaaagtcagctcccgactgtccctaggacagccccgtctgtgggtcttgcacctggcatgggccaggtgcctggaatgcactcagcgggcgggcccttccaggtggctgcagctccgcctccctgcagagtggctctggcctctctccctgctcctcccatgggggtcccacaaggacgtcgtgtccacggccctgggaggaggccgacccactggtcagcaaccttccaagccggctcctctctcaagtgcagggggcaggggggcagctgcctcatcacccagacgcagcctccagggtggcgcctcaccgacatctgatgtcccggtttctgtctgcccctagatgggccccagatgtcctaccggcacctaaaactccacgtgtctcaacagagtgtgtcatttccacacgctcattctccttccatgccctctgtgctgctccagaacaaccgggtgctttctgcctcacagccacagaacccaaacccgctttcctgagagcatctcaggccctgtggccaggatggggatccagagacccggaaggcgtctcctgcctcggggctctcatcctggtgggagggacagagctgcagccactgcctgtggtgatgggctgagggcaaaggggggggccaggcatgcaggggggctgcccaccaccccaccccagcaggcagggacagggagggggcatcccaggggcattctaggcagagccacactgggctcaacaaagggcagtcgggagaatggcacaacccaaaccgcttcctaaaattctcgcggcttctctaattttctcggtattccctttcttaataagccttagataaatacctcactttgccatttcttaggttttaattttcaagccacactagtttttaatttcattaaatcttttcaagcttcgtaaagtttgccaaatcactatttctttctctcataagggttaagattttagtatcaggaattactcgatttaatttgatacagatttatctgaaagcgaactgtaaagaggcgggaaagtcgaccgggcagcgagaatggcacacctcatggtctacatattttcttctttctttcttttcttttttttttgagacagggtctggctgtcgctccagctgcagtgcagtggcctgatctctgctcactgcagcctccaccttctgtgctcaagggctcctcctgcctcagcatcccgagtaactggggtgcccggctaattttgtttttaatttctgtggagatggggtctccctatgtcgcccaggctgaaattctacttttctttttttttgagacagaggtctcgctctgttgcccaggctgaagtgcagtggcacgatctcagctcactgcagcctctgcctcccgggttcaagcaattctcctgcctcagccccccgaggagctgtgactataggtgtgcaccaccatgcctgacttattttgtatttttagtagagacagggtttcaccatgttggcgaggctggtcttgaactcctgacctcaggtgatccacctgccttgacctcccaaagtgctgggattacaggcgtgagccactgcccctggccaattctatgtatttttaaagttctccttttccagcgtttaaaagctggtgacgtcgcacccactgcctgatgtgtgcagactgcaactcttgtgtctgaactggcaccagccttcatttctggttcattctaaactctgtggtcgggtaacaggtcaccgccgcctggcccgaggccccagcagcagccccgggagcctggaggacctgcatgttccgaagcccacccagacctgccgtgttggatgctctggggggtccccgcagcctgggttctaccaagccctccagaggatgcaggtgcccaccacagtctgaggaccactgggctcaagaaagagtgaggcaggatgcgggcaacctctttgtgcctgttttctccgctataaagtggggcaggagcacctgctggggtgagaagagcactgtggagaatgaaagcttttgggcttcagggagtgcggcgtggcattcgctcccactcctcctcctctgtgcccactgcggccgagccgcaggaaggcaggatcttgcctgttttgttcatggacacgtccctgcctcaaaaaccaggcccggcatagagcaggggctcaacaaatacgtgctgagtgtatctcacttgtatggctagctacggtgtaaccccaacaaaaccacgcaaccttgttgaatgaagtaaaggatacctgtgcctgaagttacagaagagcttccacacagatatcccaggctgaatttctgcacaaagttcttgccactttgactaataagctcagagtgattataaaactattgttttacaggccaggcatggttgctcatggttgtaatcccagcactttgggaggccgaggtgggcagattgcttgagctcaggagtttgagaccagcctgggcaacagggcaaaaccctttgtctacaaaaatatacaaaaaaaaaaaaaattagctggtcacggtggcatgtgcctgtagtcccagctactcgggaggctgaggtgggagaatcacttgagcctgggaggtcaaggctgcagtgaaccgtgatcgtgctactgcactccagcctgagtgacggaggaagactgtgtctcaaaaaaatttttaaaaaatatattttaaaaactattttttttccaattaatacttccacttgaacagtttggggtggcctctgtcacctgcctaccagatgtgagaggctggtggcctggcgtcttggggttccagcacctggggttctggagtgaactgcgtccgtcatggtgtctactctgtggcttatgcttgggtccagggggcaggatctggtttagagcaatccaggttccagtccagaccctgccacgttctggccccggcacatttcatgaggcccttagcttcccgtctgtgagcaggtgggggcccacctctgacggtgctcagtggattcagtcaggtaacatctgtgaaggcagtcggggcacgaccagcggggagcgagtctgcattattctgagttacctgaaaagtcgtatctggcaagacccaaccaccgtttcttctcactgtccttgatgatgtccccgtagaagccgtagcccagcagggacacggagtagcgaaggagtgtgctgttgtggtggactgaggacacatccatggccagcgagtcccctgtgggagagaacggccgtgagggaaggcagcccccctccagccccgccccatccactccatccccttcaatagcactttgcaaacgtgggagttacttttaaaaagtgtgaaacaaacagaacgcattcagtgcaaggattctctctcttggggtgttgg

SEQ ID NO: 1760 - DNA, 26 bp, Homo sapiens
agtaatagttttacttattaacttac

SEQ ID NO: 1761 - DNA, 340682 bp, Homo sapiens
actgtttttttgggcaattaatgcctcattgtaaatgaaaaaaaaatttttttttctttaatttgtttcattagttgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacaacgaggtaacattctctctggtggctgaaatgcaatttacttaaccattttcctattataagacatttagatgatttctatgaacattttttttaaaaatcagatttttttgtctttttaagaaaaagaggacctagttcacttatttctgaataagtttcttttgtgtggaacagatggaaatgttgggaaaaaaaagaaatctacacttttctgttgtcctaatgaggcagtgaacttagttggatagcctgggtagttcatactacctattgatatatacccccaaacagaaatcttcctttttttttttttttttgagatggagtcttgctctgttgcccaggctggagtgcagtggcgcgatctcggctcactgcaacctctgcctcctgggttcaagtgattctcctgcctcagcctcccaagtagctgggactacaggagcccgccaccacgcctgactaatttttgtatttttagtagagacagggtttcaccatattggccgggctggtctcgaactcctgaccttgtgatctgcccacctcggcctcccaaagttctgggattacaggcgtgagccatcgcgcccggcccaaactgaaaaattttaagtaacagatgtattccagaccttgttgaataccaacacagcagacagtttgctattataacttctagcaatagaatgaagagatgccaaaaataaggattacctaagggagactactgactagaattagaagaagatgggaggcttaacattgggaaacaacagtgtttaaaggacaaacagaataaggactaggagctggggcatgtcagtgagagggtaggaaggagccaggaggccagggcgggctacccatcccctccatgcaccactagtgattaccatgtcactaatccaacatatgcttcacagtcctagctttcagaatgctctccttgaaatttctcgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgatgaatgactcattagcattgtaagaaatgggttgcaggcgggacaagcacctgttgggagggaaaggaatgtgtaatgtaaaacagtagtagtggtggggcatgggcacatttaagcagcagaggggtaggtgggggctggtggcaaggagtgggaagggagaggcaagatgacttcagatgttagtttacttgattagcagcatagcgtcaacaaatgagttgggcgctatgaaaggaaaagcaggtttggacattgctgagtttggggagccaatggaatatccaggtgggaatttccattaggcagttgtaggtaaaaggttcaaaagctgaggaaagggtctggaatctaaatctgtaagtaatcacttggaatttatacatccttggttttctttcctattatctctacattatttcactattgttaatatatgtttatacctctgacactgtatgctgattagatcctgccttagagatagctcccttcccctctttctctttacagctcacacgttttgctctacctacaattgtttctacctgttggtatgtttagttctacctgattctactctatccgtcttagatatacagctctctctttccaattggaaaatgttccctacctccaaagtctttcacttttaacttatgtggaagataattatagtgctatttagggaaaaataatcaagtgtgttaagaatgccttatattcagatatatttatagtagaagggaccagtgcatactgaatattattactctcctaggcactacggctttggaaccactactttgccttctggtcctaaaaaaaattatttttaatgtatcagaaatatacatgataacattttccttatgtaaataaaaactattaagccttttttatatagagcagtggacttccatactgctatcatttgaatataaagaagcaattttgttaatttacctagatttagattttagatttgctgttttcttatttcgtgcctttaggcaggttatttaacctatttgatctctacttgcttggtatatgggaggcatgcatagtattttgttgtgactagtaggttaaccacattgtgaaggaatttatggcatgatcagaacgttttttctctctctagatgttgttattcatgaggaccaatggattggcgagacagtactacaatcaacatttagcagtcagttattaaatcttgggagttattcatctattcagcctgaagaatgtaaggcacattttaaatgaagtaatgtagtagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggccatcagtatagtggtggttcttcaccttttagggagtcagagacctctttgagaatctatagaccatttctccagaaaactggacttatgtagataggcacaaaattttgcttataattctaaagcattccacggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctcctctaggaaataaaataacataaaaaaaagaaagaaaacaaagtaagggaaacagtataaacttgtggttatggtcactggactcagatagaccaggatttgaatactggccctcttacttccagtctttgtctttaggcaatgtatttcacttcactatacttttgtctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatatatatatggaagatagagcatggaattccaatctttgaattcttaaagaaaggcagagcaagtagaagggaagagcaacaattagaataacaagaactgtgtttggaatgggcaaggtttcattatatactagggtggcccatcagcagaaaaccaactctgacatatttcatagacaactaaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatgtgcaggtgataatgagtgctatgaaggaaactaacaaagggttaagatacagaatgccgtggttctagttgagaaggattgatcatggagtagaatcagggttaggaagttgttacaatagctgcagttgagagataatgggaggccagtggagctaaagagctgagatatatttgtaaatagagttaataggattttctgatgatgtgggtctggggatcagggaagagggacaatctactgctactgaattactggtttaagtaactaggtagcctttattgggaaagactgagagggaactggtttgtggggaaaaggactatgtttcaaggcatgttaagttttagatatctttgagatattcaagtggaaatgtcatataagaactggaaacaaagttcaggactcagaagacaggtttaaaattaagaggcaaattttagagttattagcatacagataatatttcaaatttaaaagttttttaaataataaatatctgtataattatagaatcacaggggattgcaaaaataatacataaagtcccatgaactcttcttctagcttctcccaatggtgatatcttatataactttagtacaatatcaacaacaggaaatcaacgtttgtataatactgttaactagtaatatactaggatactttccctttcagtatcaataaatatagtatcagcctggcacagtggcttatgcctgtaatcccagcactttgggtggctgaggcaggaggattacttgggcccaggagctcgacaccagcctggatgatatggtgaaacctcatctctactaaaaatacggaaaaattagccaggtgtagtggtgcacacctgtagttacagctactagggaggcttaagtgggaaagaaagttgaggctgcagtgagccatgattgtaccacagcacttcagcctgggtgaccggagtcagaccttgtctcaaaaaaattttttttcttaaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgggaggccaaggtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctgggaggtggaggttgcagtgagcaccactacactgcactgcagcctgagcgacagagtgagattcggtctccaaaaaaaaaaaaagaaagaagaggcatttgaatggataaagaagaatgaaaattatttctatttacaaatgctctgataacatacctgaaaactccagggaatcaaagttaaaacaaatttaaataataagataattcagtgatataacagaatgcaaaattagtgttaaaaaatatcattaggctgagtgcagtggtttgcgtctgtaattctagccctttgggagatgaaagtgggtggacagcttgagcccaggaattcaagaccagcctgggctacaaaaaagaaaaagaaaaagaaaaaaaagctgggtgtggtggcacccacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataatagtaattagacttaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaagaaatggaaagacattccctgttcttggataggatgactcaacattataatgatgtcagttcttcctaagttaatatgtaaattcaatgtagttccaatgaaaatatatatgttatggcatataaaagttgatactaaagctcataggggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaagaaacctgaatgaatcctctgtaatcttggtgtagggaaaggctttttcttaatattactcagaatccaggggcagtagaagataaactgatacattttactatagaaaaataaattttgcataaccaaaacactataaacaaagtcaaaagacaactgacaaacttggagaaaatatttgtaacatacaacaaaaggctaatatccctaatatataaagaacttttaaaccctgagtgacaaaggctgggtgtggttgttcacactggtaatcatagcattttggaaagctgaggtgggagaatcacttgagctcaggagtttgagtccagcctgggcaacatagtgagaccctgtctctacaaaaagtcaaaaaatcagcccggtgtggtggtgcatgcctatggtcccagctacgttggaggctgaggcaggaggattgtttgagcccaggaggtcgaggctgcagtgagctgtattcatgccactgcactctagcctggcaaaagggaaaatgtgaaaaagagatgaacagtcagttttcaaaaaaagatataaaaatggctatcaaatataacttattagagaaattcaaattaaaactacatggagataccatttctcacctatcagattggcaaaattaaaaaaaagcacattctgttggcgcaactgtgaggtaatgtgccctcttaatacattggtggtaggaatgcaaattgctacaacccttgtgaagggatatttggcaatatctaacaaaattacatatgtacttagctttcaacctagcaatcccacttctaggaatctaccctgaagctacacctccaacaatatgaaaatacatatcacaaggttattcattgcagtattgtttataattgcaaaatatataggagaatgattcactaagttatgctacattcacatagtggaacactatgtactatgcagctgtacaaaaagaatgaaaaagatctctatgaactgatatggagtgattcccaggacatactgttatgtgaaaacataaaccccccaaaactgtatgtagtatgctgtccttcctgtacgaaggaatggaggtataagaaaatacctcggtttatttgtggaaagaaaatgcaggaaggataaaccagaaactaaagagattggtcacctacagggggcacataggagaggggtggaagaaagtggggaatgggaacaggatagcaggggtcaggaggaagtgacactaacaaatgaatgtaatattgttacaagtgaacctaatattgttacaaatgaataaaataactacacagaagcgggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcatctgtaaacattttcttttcttttcttttcttttcttttttttttttttgagatggactcttgttctgtcacccaggctggagtgcagtggcgtgatcttagctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctaacctcaggtgatctgcccactttggcctcccaaagtgctgagattgcaggtgtgagccactgtgcctggcctctctttttttttgagacagggtctggctctgttgcccagtctagagtacagtggtgtgatctcggcttactccaacttctgcctcctgggctcaagccagcctcccacttcagccttccaagtagccggtaccatagctgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaacagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgacataaagatatatgtatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccgtctctacaaaaaatagaaaaattaaccaggtttggaggtgtgtccctatagtcccagctattcgggaggctgaggtgggaggatagattgatcccaggaggttgaggctgcagtgagctgtgatcatgccactgcacttcagcccgggcaacagagtgagactctgtctcaaggaaaaaaaaaaaaatacaaaacacaaaaatagagaattaccatcaggcagagatcacaataataaatactgcactgacacaaatgcactgatagatgctaaaattagtaggtgaaagtttgaggagagagagcattgcatagtctcaaagtatctccccaagataccagcatactagagggaaaataataaatttataagaaaactcttcagacaccaagttaactgagtgattgggataaatatcaccagtaataagatgtatggtatcataaatgctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatatgaggtgggatcttggatgaaatcctacatagaaaaaggatattaataggagaattgataaaatttaaataacatctacattttatttaacaatatttaattaacattagtttcctgtttaagataatttataatatgtgagatgcccacattagtcgacatagtgaggaatataaggtaactctgtactatttttgcaacttttttgtaagtcttacgttagttcaaaacagagtttttaaaaaagctgtatacgatcatctcaataggtacaaagaaagcttttgataaaattcaacacttgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccgtattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaaggagctggatataagattaacatacaaaagtcaatcacatttctagagtgactaacaataacaaaggaagctgccattgacaataatattattttgtactaatagtaataaatgtaacaaagtatgtgcaagacctaaaaaaggaaaaatttttaaatgaagaaaaactaacaaagaatgaaataaacatatactttattcattgattggaagatttaacattgtgaagatttcagttcttttcaagttgatttgtaaattcagtgcatgttcaataaaaatcctcgtaagatttcaagggctcagtggctcatgcctgtaatgccagcactttgggaggccaaggtaggaggatctcttgaggcaaagagttcaagaccaataagattttcatgtaatttgataagattatatgatatttatgtagaagagtaagtggttgaaaacagcagggcattttaagaagaaaagcagggaagaataatttgccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtgtgtgtgtgtgtgtgtgtgtgtataaatgatagctaaatggcttctaagtaaaattcagcatatcttgtatatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaattatgtgaaaaatcttgaactaattagataatctttagaagttacttcacaatctttgtttttacacatacacaggaatttatggtgctttattttttacaggttagtagctaaataaagtatattctaaagttttttattgatgtagggaaatggctaccagtggacattttgagaatattgcagttgtttttcttctgaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatggctcactgcagcctcagtctcccaggctcaagagattcttctacctcagcctcctgagtagctgggactacaggtgcatgcccccatgcccagctaatttttgtattttttgtagagaccaggttttgtcatgttgcccaagctggccttgaattcctgagctccagtgatcctcttgtcttagcctcccaaagtgctggaattacatgtgtgagccaccactcccagccccagaacaactattattaaaaagtcaaaaaacgacagatgttggtaggctgtgtagaaaaggaaatgctcatacactgttggtgcgaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcagtggctcatgcctgtaattcccacactttgacaggctgaggcaggcagattgcttgagtccaggagtttgagaccagcctgagcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaatagagtgacaccttgtctcaaaaaaaataaataaataaataaataaattgcagcaacacagatgcagttggaggcaattatcctaagtgaattgagggaggaacaggaaaccaaataacatgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacaatgtttccatgaggtagactttttttggaatctaaataaccatgtgtttccatgtaaatttttatgaatcagggacaaatatataatttgatgttagagatgtttttgttccccaaaagctctatcttgttcatgaaaaacgaagcccagagaagttatgtacaagttcacagagcttattattgacaaaaccagaatttgaatacaactcttctgattccagatttgctggaaatactgtgaaagaagaactcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaaacacaaatcagtttatggagtctgctttctaaaaagtacttaagtgtttattgccaatatcttattttggtcagcaatcaatcacgtactcaagcatacttgtcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaggacatagtaactgaagaattaaataaccaatccaacacttgaaaaatattacaatgtagcacgtgctcaaaagctctctgagctcagggaacaaagcagcactgtgaatctatagtggtaatcattctatgtggtattgggtaggacaagacagccttgcagctggaaattggtgaggacggaggcctcgctgtggaaagagtaaggcacactcagggagagaaccagtgaggtggctctgagcctgtttcagaaggggcttgaggaagaacggcagaggataggatagttgggaaagcaggatcaaatcagactccagggactggggaaccaattggctgttacagggtggtggagtcaaaaaagaacagaaattttctgtttggttaattgatagaaaatgatattattaacaaagtaaagaagtatgggaacagcacaagttttttggggatagtaaataattccatttccattgattaaaaatatcaagtttgtttttacatctaaactgattcaagacttagctattgtacatgttttagagaaagcaaaactatattttatatctaatcatactttacaacataaaatacagttctaaaaaatattatttgtgaagaaaaatataatgttgccatcttttgtctgtctgtatgttttttttcccttagattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacaggtaaatattttgactgcctccttaattttagattatgaaaaaattaagatacaagaccatcttagtgtaccatttggttatcactatatatgtatcatcagctattaaagtatggtatcacgtgtgatagagtaatgccaactaaggtactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaagtcttaaatttattcccaggtatactactttacccttttagtgaagatcttacctccttcaaataatgttctttaaacatttaattctggagaagcttctacaattttttttcagccagagtactctgataaatgctatggttataaggcagatgtcaagggagttaccttaactctttcaagtcacaattaatgttcaataaattactgtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaaagacagtttcatttgtggcttatgagttatttttccctgctaaattaatttagagattgattcagtatattattattttttacctgaaagagttaatgtctctccaaacttctgccttccaaatagttatttgtagataggagctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagccgtaacaaagcagattgctccatgtttaatgtgaatattcttttaaaattaatagttttttggttaatagaagagaaattacagttgtctctaggtgattctatggtgtttaggttagtattgaaaacatatgaatccaggaattaagatgttgttgttctttgtacattcattcatccagccccccttatttataaccatcattttaaagttttaacatctacttcaatacctcacatcagtctttttaagataaaaatcccaattttgaaggattacttaagtaattctattttcctgattttacttttcttttcaagagaccaaccccatttccaaattcccagcaaagagaatctgattgcccagagtaaatttgattcaaaaaactgtgatcaggaagacaaggtcacacaatacaaatatgagagcttgagcttatttcagtggatgggaaaacagttaagggagtcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagttcaagttctcatcttaaaaaaaataaaaaataaaaaaaaattggattgtaaaacttcacgtatagaaaatatgttatcatataataaatatttttatgtttatataagttaatacataaaaattttcaagaaaaccctttatatataatagtatctcattttaataaaaatgtatctataagtacatatgtgcatttgaaaacctggaaatatgcatgtatagcaaaatgctagcagtggttatttctgtatggtagtattatatgtgctttaattttttctttatacctttagtttgaatttcatatgtgtgtgagcatctgcatttacttttaaaaacttctattataaaagccttcaagcatatataaaagcagagagaatactaagcataaggcactttttttttttttttttgagacagagtttcattcttgtcacccaggctggaatgtagtggcatgatctctgctcactgcaacctcctcaagttattctcctgcctcagcctcccaagtaagtggaattacaggcatgtgccgtcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttaggtacctattagccagcttattaaaacatggtcagtcttgtttcacctgttacctcccttgtctttactgtttaaatatttcacaataaatatattttattttataattaaaaataaaattaaaaccttatgctttttaaaataaaagaatagttaatgtttggaaaatctagctaacaatgtgagaaaaaatagaattaaatttatactttatgtttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaaccaaaaaaaaacagaaaaaaaattacattgtcagaaaataatgcagtaagcaaaagacacatatctatagagataaatggggaaaggatatgagtaggcaagtccccaaagaagaaataaaaatggccaataaatatatggaaaaattgttcttacaagtaattgaaaacacacaaagtaatgatgatagatgatttttcttttaagaaattgatagagaagatatgggaaaacagctactgtcatcagctattggaaatgcaaactggcagaacctttcttgaggataactgacaattaatatgaacaaattgggggtacttttagcccaataattttagctataggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgctctgtctttacagatttactgagatgtttgatgattttccaccaaaaaaaaaaaaaaaaaatctctagtgaaagaaactaaggagatgagcaggtgtagtaaattagatttatggcctgaagtgagaaactaaaaagacagctgatgttatcagaaaaattagtgctaagaaaccctcttttgttttattatagttttgaagttgaatttactaatacagaatatgataatacagataagttgaatttactaatagagaatataacagtaataaggtctgtgttattgtggctttaagtattagaattgtggccggcgtggtggctcccgcctgtaatcccagcactttgggaaaccgaggcgggcggatcatgaggtcaggagatcgagaccatcctggctaacacggtgaaaccccgtctctactaaaaatgcaaaaaaatttagccgggcgtggtggcgggcgcctgtagtcccagctactccggaggctgaggcaggagaatggctagaacctgggacgtggagcttgcagtgagccgagattgcgccactgcgctccagcctgggcaacagagcgagactccatctcaaaaaaaaaaaaaaaaaaaaattgttactgagagttaaaaataagtacaattgtgtctaaatgctttttgttctagaaaagttaactaaaataactattgaaatatgagtgaaatattagacttgggttcatttcagtgtcctttctttaacaaaacaaaacacaactttgcctatagatagatacatgagaattttctttacagaaagcagttggttattataaatgatgaccgttcaggagggcaaggaatctttagaaaatattttattaaaattatctctggtggcccggcacggaggcttatgcctgtaatcccagcactgtgggaggccgaggtgggcggatcatgaggtcaggagttcaagaccagcctgaccaacatggtgaaaccctgtctctactaaaaatacaaaaattagccgggagtggtggcacgcacctgtaatcccagctactcaggaggccgaggcaggagaatcacttgaacctgggaggtggaggtttcagtgagccgagatcacatcactgctctccagcctgggcaacagagtgagactctgtcttggaaaataataataataataataataatctctagcatgcttctgttgtcttaatgcatcattcatattttgtctctgtttacccaaattctttagtgataaaagattagattcaactgacttaatcagatcaatctatttaatctgatactaagcctagatttttttcctttttggtgacttttgtttttactgttttttttaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatctttatatacataaattctgctatttttatttcttttgaaacagggtcttgctctgttgctcaggctggaatacagtggtgtgaacacagctcactgcagtctccacctcccaggtttaagtgattctccccgttcagcctttcgcgtagctcaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataattctatataaaagtgaaatataaatctttgcaaatatctgaactagattccagtagttttaggaactatgtgccaggaaccagggacaaagagcaaatacctattttttattatatgacaagtgggagcagaaattcagttccttactttatcttggccaaatgccagattaaaatgttactagttgggttaattcacatatatgtataaatatgttttccaatatatgattgaaggttagcattgttatatcataaaactatgctaaggagaatacaggcagaaaacaaagacaatacctctcaaaaaacccaacttttaattgaatacagagatttcattctcaaagaagagctccttattcctagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctacattactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccatgctgatgatgaaagattctgaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctctttcattctctttatgttcagctatgagggctgaattcatagtttctgtcatagtgtatgtgtttttaagacaaaaatggggagagaatatgaaaacacaaggaacttttccctaacctattttatagttaaacaaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcatgaccttttaattcttttcaagagttgtgtaaatttacaaaatgataggattatgtgaacattcttttaaaattattgaattattaagaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaatcagccaggcatgatgtcgggtgcctgtagtcccagctacttgggaggctgaggcaggaaaattgcttgaacgcaggaggcagaggttgcagtgagccgagattgcaccactgcactgcagactgggtaacagagcaatactctgtctcaaaaaaaaaaaaaaaaaaaaaaaaaaagactttttgagtggagggaggagagcaagggtttaaaaactaactgttgggtactctgcctactacaggagactctacttgggtgatgatatgcccatgtaacaaacctgcacatctaccctctgaatctgaaataaaaatcgaaatttttttttttacataattttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaaaaaaaaataataataattttgtagtgatttgacatgtctttggaaagatgtggtattgaatcttctacagtttgttacatattcgatcgctacacactcctgctaactcatgtagggatatgtgacacaattggaagagatgatgaaaccatctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaggaaaactcatagacctcaccagtacacagtaagacgaaagtaaattaggaaaaaataatgtctgggagatagtagatattcagtatttgtttactggtgaatggatgagccattagcagtgaattatgaatatgcttgaggtttcttgtgagtcacctgagaaacgattaataaatgagaactttttataacccacacccagagtatatagatgataatggtgagcggaaagttggaaaaaagtttaaaagagaacaggctattgatatttttaggtagagagaagaagaaaagttcacctcctatttggcttttttttttttttgagacggagtcttgctctttcgcccaggccggagtgcagtggtgcgatctcggctcactataagctctgcctcccgggttcaagccattctcctgcctcagcctcccgagtagctaggactacaggcgccagccaccgcgcctggctaattttttgtatttttagtagagacagggtttcaccatgttagccaggatggtctcgatctcctgacctcgtgatctgcccgcgtcggcctcccaaagtgctgggattacaggcgtgagccactgcgcccggcccctatttggcttttcactatgatcagtttaagagaagacagggcaaggagagaggacatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacatccctgcccttagattctaggaaaatagtaaagaagacgaagaacaagacctcagtgtatccttttactacaagtgactgtaaatcaactataaaattagccatgtttgtaaattaaagttataattttggcccaataatttataatatatctgtttgttgtttgtaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaattagtctgtaaacccttactttctaaaaataattaactagagctagtcgaagagaataaaattttccgagtgatagatagctatttatggaagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatagaatttaagggctaaaagtatcatatgatctcacctctgagttgttgtggaagctagtaagacatttaaggtgttttcccacctttaccttagaaattaaagctagcaaataaatgttgtatggtaaaactgctaatcagctcagtgaaaaacacattgttttttgaataataggtagtcaaaagctcagatatttttctctttacctcataaattacatgtgtttacaaaatagcactcagtgttttatgctccttatgattatttctaaatattgcggtatctaaaaaccaaattcagatatattccacatgttatcatggcatacttcaagaaaagttatagaagcttaatttgtaaaccttatttctctttacagatattatgtttgttataaataagtgaataaattttgctattactgtgaaagttgcttttgtggaaaagaagattgaattaagatgtatggtaggctgggtgtggtggctcacgcatgtaatcccagcactttgggaggccggggtggggggatcgcttgagcccaggggttcaagaccagcctgggaaacatagggaaaccccatctctaccaaaaaaaaaaaaaaaaaaaaagctgggcaggtgacataggcctgtagtcccagctacttgggaggctgaggcaggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatgtcattccaaatgtttctattcaatataagcatttattggacaaaaatgttgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttacaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagtgcagcctaaaagcctttaaattgttattagagtccagattatatggtttccttgaaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatatgtactgtggatgttatactagttgacctaagtagacttattgtgcccaagaagcttggtagtccatttaagaaacacttaatgaacatttgtgtggcataacagtcccagactatgagtgggttgatcatattttacattggttgtaacttggagctgattttccaatggaagcaacattagatattgcattggagtctcatacgaggccacagacatttattaaattaacatgtagatagcatagttcctgttcttcaagctatcataaaactcaaataccatttttaacaatgtttctacagaatattcagatttacatttttggaatacaagaaatacatttatttttctgtactagaagcaaaaaaccccagcaggtcaaaccacaattaaggctcctatttaggcagcactaggaaatgtttgggtctctcaagaggttatagtcaaggtgtaggctggggctgcagtcatctgaaggcttgactggggctggaggattcatttccaaagtggctcattcgtatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagttagctgtgcgttggagagtggattagaatgaagctagtgcagagaagcggtaagaggctgttgccttattttggaggggagatgatggtggcttgactagagaggaagtggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatgttgatcatattgagcttgagttcctgagaggtaacaagttggaaagtggttagatgtaaagaaatgcaatttgcaagagaagtctgggctaggcttataaggttatttgtggtaattgaacttttgcttggtttctgcaccctgttttgtttttccttcttaatcttcagtgattacctctcataatggattattctcactagcctataaagacactcccatatttcttttattaaaaaacaaacaaaatcatccattaacattacatctccctcttgtcccttcgtttttctattctgttttatacccagccaaactttgttaaagagttttaaatatactctctctcccctattatgtcttcagtttcacttcagttattccattctactcctaccatgctgcagaagctgcttttgtcaaagttacacttttgatgttgcctgaggcatggatacttctttcctcactctaactgctctcagttatattcagcatgtcagtccacttcctccttcttgaaacagcctcctccttgctttctaacctgtctctcaggcccttctttctcagcctcttctaccccctctttaaatgctggggttaatcttgagctctcgtctgcgtccttcctcttattctttctgtacattctgcctggatgatcacagctgttttcgtatttgtacttaacatcttcaccctgattttctcctccaggctccagtagtcaggtatcaaattctttgcttgacgtccatctcacatttaaacatacccacaatagactcttgtttttcctaaccacactcaaatctagttctcttcatttttatactttctggaaaatggcacaccatctacccaattatttaggctggaaacctgggcacaatcgtcgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctacgacctgttgcgcaaaccagcacaccagcagtctcttggtggggctcctcctggccttgcctcctcccctttattctctacccattggcagtgtgattaccctttgcctttgcttcacccatcagtcgtctccttatgcttgtttcctctgcagtctcatctgctgccactcccctgtcgtccagcactctagccacgtggccttctttcagttcttcattttgatttttctccttaggatgttctcgaatgtcttccttctgtctgactccacaaggctggtttcttcatgtcttagattaaatgctgctttatcagagaggcctttcctaaccactcttctttattttctgttatagtagcctgggtgtgcttactgtaatttgtagttgcatactgtcttttctagaaaacatttttactgaagttaaaattcatataccatcaaattaatcttctgaaatgtacaattcaatggctgtagtatattcccagggctgtgtagctatcaccacaaccagttaggacattttcgtcacccagccctttacaaagcctcatactcattagcagtcactctccattccccatgcccctcaacctatggcaactacgaatctgctttcggtctctatagatttgcctgttctagatattttatataaatattatataatatgtgatcttttgtgactggcttcacttagcatgatgttttcaaggtccatccatgttgtagcatgtatcactacttcctttttattgcaaaataatattgtattgtatgcatataccacattttatttatccattcatcagttgatggacaattgggttgtttctactctttggctattatgaatgatgctgctgtgaacatttgtgtacaagtttttgtgtggatatgtgtgttcatttctcttgggtatatatttaggagtggtggaattgctgggtcatatggtaactgtctgtttaaccttttgaggactaccaggctgttttccaaaattgctgcacaattttacattctcatcagcaatatgagggttgtaatttccccatattcttgccagtacttcttattctgtatttctttttgttgcatgtgctttcgggtcgtatctaagaaaggtgtcatttctaagccaaggttatggagatttgctcccgtattttcttctaagagtttagtagttttacctcctacatttaggtttattatctactttgagttaagttttgtatgtgggataaggaaggggtgtaattttattttttggcatgtggatatctagttgtcccagcgtgaatttttgaaaagactgttccatccctgtttagtcatcttggcaccactgttgaaaagcttattttctttcttcttctttttgtagagatgaggtctcattgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttatatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgtcacattaaattcccccgctaatgagcctgtttctgaattctgttctcaatttattttttaaaaatcaatgtagttataaaataggtaccacatgccatgattaaaatgcacactacataggaggttacaaaacaaagagtgaaagtctccttcaccatccaaccctctctcaccagtgctgcttccattgctggtgagaaggttttttgtatgtccttccagtgatttattatgttcatcccagcacatgtgtatccctttctttagaagcatgtggacagaagaatattgttcatgttgttgttccctagagtctatcctggtgctccttccctaatagcacttgcaaatgttcttcattctttttatcagctacatagcattaagatgtaggatgcactgaaaattgttaatccagttccctgtttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaaaacctttttttccttctaggatgtcacagaacatcctagagttgttttaggcattcaaattaatcctgcataaaaaccaagtgctttttggaattatttttcatttaagcatttcttttatctgaaaatctttttgaaggtcgtgtgttgtttactcttttgtaggccagcgttaatgactgccattgatggaagacatgatgtttgtatccgtgtagaatcaaagctgatagagaagattcttctcaacatttctgcagactgcctcaacagagtgataggtaatatatcagtgtgccatcaagaagttgttttattcaggagtataaatggtatatcggaacagaaagagcactgtactttaaattaagagcttttctgtccatatgaaaaccgaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagagtgaagtcaatgagtgtgtgacataatatatatgaagatagtccactgtcagtggaatggatttgcaagatcttcaaccgtgatgtcttagttgtcagtggctaagaataaagcaaagataatatatttgtcaggtattcaaactccattcctgttctcattagcctcagatcctctaagctgatgagctaatctggttccgtgattgctttatctttcaatagtagattgtttttcgtgtatttttttagttgggggtgtctagtaattttgggttgaatgctgaacattgcatatattaagtagaacagtacaaactgaggtaaatagtatttgtacctggaaacaggcatgcctctcggtcctttactggaggtgaggggtgagcaggatggtcagtcttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccacgttcttgcacctccccaagttgcacaagcttttgttggttgttatttggtgcatcctaacctggtgggcgggagcagggttgttcctctttgattctggtccagccccagtcttatacaggatgttgaatatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggggttttttttcttttttctttcccccatctgtactggttcctcacctgtaccctggggcaacaggatttggtgtccctcctccagcagttgaaggcttttgttccttaaaggggaggccagatggtgctttgtgttttgtagttggaagctttctctgatgtcttgccctgcccccagtcttatgagcacctggtggaggtgagactactatgtggaagagcctgtgaggatgcagatgttccttatgttgctgacactggcagttcattggctttttgcaattaatttattaataaaaattaatcacattcttctttcctgcctgtatggaggacctgtcttcttcccaaggcctgccccaagggaaactgtgctcctgttccatctccctggaggcacctgtctccttatgtttcagtctttttggctgttttacaaccttggttctcatgtgtattcaagaaaatgatgatttgatatttattcaattttttccagtaactgttagggtaggagccactttttccagctttctacatcttaattagaagcctctctccgtttttttcccccattttctttatttcatttttattcttttggctattttcattccttttcttaatgttacttatatattttcagtgtaatctcttcttttttttttttttttgagatggagttttgctcttgttgcctagactggagtgctgtggtgcgatctcagttcaccataacctctgcctcctggattcaagcaagtctcctgcctcagtttcgcaagtagctgggattacaggcatgcgccaccatgcccggctaattttgtatttttagtagatatggggtttctctatgttagttaggctggtcttgaactcccaacctcaggtgatctgcctgccttggtctcccaaagtgctgggattacaggcgtgagccaccgtgtccggcctatctcttcttttttgcataatgtaaattagtctttatctcttagagaagcatcattctcatatcacatatacttcagtgttttgtccattcttgagacaattaaagttgtactacttggcattaattagattgtgatcataagtcaaaatgtcattggttataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggttgatggtgctctgtcattctggtattgaacaacctgccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcacttttctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagagacagagtcttgctctgttgcccaggctggagtgcagtggcacaatctcagctcattgcaatctctacctcctgggttcaagcaaatctcctgcctcagcttcccgagtagctgggattacaggcatgtgccaccactcccggctaatttttgtatttttagtagagacagggttttactgtgttggccaggcatgtctcgcactcctgacctcaagtaatccggctgcctccgtctcccagagtgctgggattacaggtgtgagccaccgctactggacgggaggagaaatttaaaatgggtttgagacttgaggaaccaaaagaaacaatgaaaccattcaatgtgtgtgctcctgtcaagctagcagcgatcttgggagctctgtgtttttgtcttttgcagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatgaacaagcttcttttactctgtgtatgtttttaaaaattcctttggttcagaggtggtggttgttttttaacttggcttccctaagaatgaaccacaagagttttgtgattctttcaaaaataatatgccaaaatgactttgtgggagcacacacacacaactgcatgtttctgtggagaaggatccatagctttcaacaaatcctcagagggttctgtgaccaagaaaggtaagaacaaggctttaactgatgagtttctttgtgggggagataagggaattagagcaaatgattgccaaagttttgtctagcaactaataaggtgggtacagaaagaattgactccattttgtatctagagagactggaattcaaacaaaatcattggctcccttcaatgattcgttgaatgggtgatgaaacttgagcctgtagttgacaccttctaatctgtgctctctcaactataaccacactaggcggatatttggaattctgatataaaatctgcccagtcaatataggccaaccaagagagctgttcgcttaagtgtgcccttccccactttgtcctcaagtggagacctaatccctacatcaaccagaacataatccccaggaacagatggctcttcacatcctattgggaagaaatctttaaaccatttcaggtgagtcaacagatcacaccaacatctcttcacagttgttggtatgtatttcattcattaacacatatttccaggagcccttatttaggttgggaactgtttcctccaatcctgaggaatctgagctatctacagaagttatgagctatttaagtgggatcaggatcagcccattgctcctgctatggtctgaatgtgtcctcccaaaattcttacgttgaaacctcatctctgatggcattcagaagtggggcatctgggaggtgattaggtcatgagggctttgcccttgtgaatgggatcagtgcccttacggaagtggcccgagggagcttctttgtccccttctgccacaggatacagccagaaggtgtcatctttgaagcagagagcaagccctcactagattctcaattttctggcaccttgatcatcccagccttcaaactgtaaaaaataagtttctgttacttataaattgcccagtctgttattttgttatagcacccagaacggactaagacaccttctgtgtgtattctttacctgagttgacaagtaagtgtctttattctgttatgttttcataaaactcagtggggtagccagagtgtcatccagcagtcccatatctggcagtcttatggtgggcatttcagggagacctcattcttcatcttctgatagttcagcttgcagggacagctctcctatttttagagaaccatttttatttgttagtcacttagtttccccaaaggtatcctttttctaaaagcgttagaggcattcacctttctccccactagtaagatctgtgctgtttcattttacatcttttttttttggttgggggaaagggggctgatcatcaaatgagttgacaacattgggtgcatgatccaccctgcagacgttcgctgaatgtctaccatgtgctaggtactgggaatgcaaagacacaaatgtctgccttctgtaagttcacaggcaagctggtgaagaaatatttaaacaaaattatatcagcgccaggattaaatctgtgtggaatacagagccaaggcaaaagaggtaacagtaggatgggtttgttagtcgtgactcttggttgcaagtgataaaaacccaactcagagtagcttgagcaaaaaagggggacttgattgactcacataaatgagggtagtaccagcttaaggcacagttgaatccattggcctaaattacctggttaccccaactccctaatttatctttctttcttttttctttctctctccctctctctctctctctctgtctctctcatcagaagaggtcttttacgctgttattgcaaaagcatagatgtttctacagagttttgataggataacattttcacagtgattataaatttacatcatccctagaattctaaactactgggatctgaggccgtaaggtgtttaagagtattctgacattaccttagattcagcaaaacttgaatagttgatcatgcctttcttagaagaaaatatctgtaatttctcagaacaatatagaatgagacagaaaaactaaccatccctatgtgtcttattttaagtgatatatttgtatcctgatgggtttctaggtgttggaacacaggtcatgaatcatagaacaattagaataaagtgttcgtctttatcagtagcttaattctggcccttcatttaatgtcaacagggtagaaatgtgtgagaggggatgaggtttgccaattaattgtcattatgtctttggaggtcttgaacctgatttgttattatgaagtgaattctacccacttaaggcatacatttgctaaaggtgacctctctgcttccacgttgttaagaaatcgtgatttttttcaaaaccatcatcagctttacagtttttgaggaaagatctagaagcctgttaaaatggagttaccaggcagggttcagcccaggaaaccgaagccactctgggaattctaaacagagagagattaatgtggaattcaggtgtttgcaaaggtattggaaggctggaggagcaggcatcagtctgagctccaggaggctgccacgtgaacggtggattcatgaaaacatcaccattggctgccatcttagactgaggatgcagctgctgccatcctggcaactgactctcaagcacatggaagctgggagttagttgctgctgcccaaaactcagtccccacagctacacttgccaggaacagtagcttcaggaagatagcctggatttcactcatcttccatattgcacatgtgtgtgtttcattgatggaacatgattcacactgagagctttagctgcaagaaagtttgggaaatatgtcttctctgaggcttttggtctttgcagttcaggagcagttaggaggtgggactggttggttgcagagtgagctgatttactgcacttagtctagcttattaaaggatgagcttataaacaccccaggtaatatcataatacataagtgctacctaattactgtgtgggtctgttaccaagaatgtctaagtcaagaaattgaagattgtttccttaagattctgcatcctaatgtagaatctttcctattagagtataagtaaattcttttggtatgttatttaagaatatttgtgaataggcttaattaaacaccatgttaagaaattataaacttaaggccaggcacagtggctcacgcctataatcccagcactctgggaggctgaggcgggcagatcacttgaggtcaggagttcgagaccagcctggccaacatggtgaaacctcatctctactaaaaatacaaaagttagccaggcgtggtggtgcacacctgtaatcccagctacttgggaggctgaggcaggagaattgcttgaacctgggaggtggagcttgcagtgacctgagatcacgccagtgcactctagcctgggcgacagagtgagactctgtttaaaaaaaaaaaaaaattataaacttaaaaaaaagaacgttttcctttaaacaaaaatgcatgttccttgttttttgttttgttttgctttgccttttttgagagacagtcttgctctgtcacccaggctggagtacagtggcacaattatggctcactgtagcctctacctcctgggcgcaagcaatccttccacctcagcctccctggtagctggaactgtaagtgcagaccacaacaactgattttttattttttgtagagacagggtctccctacgttgcccaggctggtcttgagctcctggactcaatcgaccctcttgccttggcctcccaaagtgctaggactataggcatgagccactgcaccaggccgtttcttttttttttaaactttggaaaatatggatgaacgaagtgagaaaagtaacccttctgttattctaccaaccaaagctaattgctgccaacattttaatagatattccttcagttgttttatgcatgtgtgattttatacatgtgtctactttaaaatatatagtctttcaatgttgcccaggctggactcaaactcctgggctcaagtgatccatcacctcagcctcctgcatgtatctacatcttattttattttatttttagagacactctgttaaccaggttggagtgcagtggtgtgatcatggctcactgcagcctcaacctccctgggctcaagtgatcctcctgcctcagcttcctatgagtagctgggactacaggcatatgcctccatacctggatactttttgtattttttgtagagacatgtttttgccatgttgcccaggctggtctaaactcctggcctcaagtgatcccctttgcctcagcctcccaaagtgctgcgattacaggtgtagactaccacgtctggccaacattctcattgatagtctttgcacacatctttcattccttctgggaatttattctaagaaaatagaattttggggtcaaagtacttgtacgtatgtatctgtaccaggaaaaaagcagaaattccagtatcaacagataacgagagccaagcaaggtggtacatgcctgtagtcccagctactcaggaggctgaggcgggaggattgtgtggcatgagcccaggagttagaggctacagtgagctatgattgcaccactgtactccagcctgggcaatacagcaagaccctgtctctgaaaaaacaaaacaaaacagataaccattgttactattttgttgaacattttccagataccctgatagaagacagatctgtgcatgcacatacacaattttacataaatgggaccattccatataggccagtatctagtgagtactttttttactccacaatttgccatatatgtctttccaaatcaatcaacatagattaaatcatatcaactacacaggattccatcatctgtgtgtgctcttgaatcctacttttaaaatgttctcagaaaggttatcctgaaatatattcctatcagaagttttccacactctctctaaactgaatggcataagtaaaagactagttgttaggtttaaaaaaggttatctgttttaattggaattttttttttgaggttttctttttcttttttctttttcttttctttttgagacacagtttcactctgtcacccaggctggagtgcagtggtgcgatcttggctcactgcaacatctgcctcctgggttcaagcgattctccagcctcagcctcctgagtagctgggattacaggtgcgcaccaccatgcccagctagtttttgtatttttggtagagacaggattttgccatgttggccaggctagtcttgaacttctggcctcaagtgatctgcctgcctcagcctcccaaagtattgaggctacaggtgtgaaccactgcgcccagccttaattgaattatttttttgctaaagtgattgtacatttgtttcatatgcttatcagtcatttgcagtttgctttttcatattttaccttagaccatttttatttgggagaagccttttattaaattagtatgttctccttataaagttagtaatttttaacatgtgttgcagacatttttcccaagcttgttatatatgttttgacatgcagaaatcataaatatttacgtggatcaacccatcaatctttttctttattgtttctagattttatgacatgcctagatagcttcttttctactataagattatacacattttcttcaaaaaattttttgaaacatttatgattgttatatttgtatttaaatctttaattatctaaaatttagtgcatggtatgaatggatctaactgattcattttcctaaaatggtcagctggttgtcccaacactattgatttctttctttcccatcagtgacgtagatgtgatctttattataatatgaaattattattcctgctagcattacctgtggactttctagtctgtttcattgttctatatttattgctgagccagaaccatacagttagaattattataactttacatctgataggaaaagtaccccatatttttcttcattaaaattgtttttctcagacatctttgcccatctgttcttttttattccccattacgagtatatgttgcagtgttttttagtatattcagagtgtgtgaccatcagcacactcaattttggaacatttcatcacccccaaaacaatcatccatagttacattaactataccaccccacagctcttccttaagaggagctaacagtcgctcctccataaccaccctctttcccccaaccctaggtaaccactcttctacttagtggctgtatagatttcactattctgacatttcacatgaatggaatcatacaatatgtggtcctttgtaactgatttctttcactcggtatagtgttttcaaggttcacacatgtagcatgtatcactacttcattgtttttattgccaaataatattccattgtatggatataccacattttatgtatctattcatcagttggtggacaactgagtttttcccactttttggctatttttaattatactatcatgaacatttgtgtgcaagtctttgtgtggatgtatattttcatttctcttgggtatgtacccaggagtggaattgctgggttgtatggtttaaccatttgaggaactgccaaacttttctaatgcaggtgcactattttacattcccatgagaatgcattggagttctgatttctccacatcctcaccagcactttttattattatctgactttttgattatagccatcctagtgggcatgccatctgttcttgagataagtttagaatcatttttatcccattgatatttttaatgagattgctttgaatttatggatcatttggacatgttttcagtggttaaggcttactatttaagaagagcatgctttttcaattaataaagtattctttaatgttccttagctttagctttatttagcagtccacatttaaagggtattaactatggaaatttttttttttttgatacagggtctcactctgttgcccaggctggagtgcagtggtatgatctcagctcactgcaacctctgcctctcaggctcaagctatcctcccacctcagcctctttggtaactggggctacaggcatgtgccaccacacctggataatttttgtattttttgtagagatggagttttgccatgttgcccaggctggtctggaactcctgggctcaagcaatccacctgcctcagcctcccaaagtgcttggattacaggtatgagccatcaaccagtttttttgtttttttaaatcattgatttcaactatgctctgttgaatcccttttccatcccctcatgtctcacatgcctcacataacttcccaggcattgtgttttagaaagtctggtattgtttaaattccagcctcattttgctcttctccagagcatgtccagctagtcactaaagggacttggaatggggaggagataggtgcactcttcctttcctttgactccagctgttggagctggagggagggcgtgaactgtcaccgaggtgaattctccccattccttcccagcttcctgaggcctagctcctccagtgagctggggagggagaaaagaaggaaaggggacagtggtacttaccaggcagctaccactgtggtcctctcctttgatggactctgcttttctagccagtacttaactgctgatgccttctgtgcagcaggcgttgagtactcctctttctggggtccatgtgagagttctttcagagctcactcttctatgtactctatgtactcactctatcatatgtacacagttgttttcatgggagatgcagctctgtctggtctttcctgccccctccactctctccaactgtacctcctttctccatcttgcaatctctctctgattcacttcactcgtgctcagacaggcatggagagcaggtcagcaaattcttcacactatcagactttagacaagctaaggaattgtccttctctgcatactgtatatagcacagtttgatttatgtaacatcctaatcatactgtctggaagaatcttaccaaaatgatatcattattcccctacatggggaattagggcttgattttaccttctttattataattatttttacttgatcaaattactaggaaatattccctcacttctaaagaatacaatttccctgtgttagaaagatcagtcccggtgtggtggctcactcccataatccctgtaccttgggagcctgagacgggaggattgcttgaggccaggaattggagaccagcctggacaacatagcaagatcttgtctctataaaacactaaaaaaaaaaaaaattagccaggcatggtgacacactactcaggaggctgaggcaggaagatcacttgagcccggaagtttgaggctgcagtgagctatgatctgccactacactccagcctggatgacaaagcgagaccctgtctctaaaaaataaaaacaacaacaaacatacataaataaagagatcacatccaaataatagaaaaagatgatatggttttggtccccaaaactgacatcacgtaggagatattggaactttgtgggtgggagccaagcccatgctggtgccccttctctaggtcacgtctatactgcttgtttggattccttggcaaaaactgactatgcaaagacagtaggatgcctgactcaaattgggtcaatcagatcctttttcttggaatttaaaaaaaaattgcatgaaaacgtatagttaaatgcacaggtcttaagtgtacaatttagagttttgacaaatatatacattcatgtaactgaaccccaaacaagatatggagcatttccatcaccctagaattttcgttcatctccacttccagtcagtctccatccatgatggccaaccaccattctgatttctatcactatacactagtttgatctgtgtttggacttcatgtaaatgaaatcatacagtatatattcctttgtaactggctttttttaacctaagaatgtttttcaggcttatccatatttttatgtgaatcagcagtttattcatttttattgttcagtaatatatcaatgtgtgaatatattatccattcgtctgttgaagtcatttgagttctttccagtttcgaactattatgaataaagctgctaaaaacatttttaaaacaagtcttgttgtggacgtaagtttttgttggggcagggatttaaatagctcggactgagattgtcagtttattggataagtatatatttaacttgagaagaatctgccaaacagtgctccaaagttgtgcaattttacactctccgcagccaaaacggaggcttccagttgttgtacatccttgccaatatttgagatgtcagtcattttcactgtagccattctagaggcggtaaagtggaacctcctggttttggtttctctttcactgatgactaatgacgcacaacttttcatgtgctcattggccatttgtataccttcatttgtgaagtgtctctcaagtcatctgcacatttatcttattgggttgtttgtctttttactgatcagacatatgtattctagataaaagtcagatatatgtattattgatatttcaaagcattttgttcagcagtagaaatgctggctatatgatttgagaataaaaatacgtatgtaattgtaacaggaagtcttaaataaattaaaatgtcactattttgaataactagaatatatattaagaaaaataatcccaggaaataaaaaatatgctagtaataattacacataacagatttacaaaattatattaccatataacagtaatacataattctaaataaaaataatcatgctcacagataaaaccaaaaactttaagagcttaatttattgaaagcaaatgatttaaatatcatgagggaaataaaaggagacaagaattagtggaacactctactgtgctcctgctgtttgggaagatgtactatacagagttaattcaacaataaacaaagtccctgagggatggcctatacgagttgacaagttgatttaaaaattaattgagggaattaaacagaaatgtaaatattccaataaccatcgaattatacattttaaatggatgaatcatatatgtgaattatatctcaataaaacgattataaaaaaagaataaacagggaatttttttctttttgagacagagttttgctcttgttgcccaggctggagtgcaatggcatgatcttggctcaccgcaacctccacctctcaggttcaagcaattcttctgcctcagcctcccgagtagctgggattacaggcatgcgcctccatgcctggctaattttgtatttttaatagagatggggtttctccatgttggccagactggtctcagactctcaggcttaggtgaacctcccgcctcgctctcccaaagtgctgggattacaggcgtgagccactgcgcctggcctaacaacagggaaatatttttcaagttaaagcaaaaaaacaaggtaagccaagtaaaactatataaaaatatatgattttggtgtttacagtgcattgggtaaaaaatcttactcagaaacagtatgtaaaatatttcgtttttagaaaaccatacattaaatcaatggagagtggccaaaaaattttaacactgtttatctcaaggagctacaactatggtaaatattttccttaataatgaaatgtggaaacattcctgagaacagaaataagacgaagatgtccattatcatcacttgtattcaatactttcctggtattcctaacaagagtaataaggcaaaaaagttgaaataaaaatactaagattggacctaagatacaaaactatgtatgtattattaacaactcaaaagaatccagagacaagttattagaattagtgagtttagcatgactgaataaatggtcaaaataggaaaaccaactttatttctgtacaccagcaagagttagaaaataaaacattttaaaacaataccatttatggtagcataaaaattcaaatgtctggggaaaaatttaatgaaaagatgtccatgacactttattatttagagaaatgagagaagaggtaaataaacagaagtacataccatgtgaactgattagatgacccagtattttaaagatgtcaattctcccctgaattgacttataaactcagtgcaaccccaggcgcagtgcctcacgcctgtaatcccagcactttgggaggctgaggcgggcagatcacgaggtcaggagatcgagaccatcctggttaacacggtgaaacccccgtctctactaaaaaaaaaaaaaatacaaaaaataagccgggcgtgatggcgggcgcctgtagtcccagctactcgggaggctgaggcaggagaatggcgtgaacccgggaggcggagcttgcagtgagccaagatcaggccactgcactccagcctgggcgacagagcaagactccgtctcaaaaaaaaaaagaaaaggaaaaagaagaaaatctcaatgcaatcccaaccaaaatcacaacaggcttcatatatatgtgtgtgtgtgtgtgtgtgtgtgtgtgtgtgtgtgtgagagagagagagagagagagagagaagttgcatggttaggtggtaaaagcagtgtttgccataaaaatcaggtcgttggttattttggttattttggtggggagggagaggtagtgtttggaaggggacacgctggaaggttttgggacgcatggtatacccgttgtcaatgtatggcctcgcacctccaaatccatcctttaatacctgctctgcggtcacagccagaatccccttccgcggctcccctcgcggcggggaggatgctgaacagtagagggcgctggagacacgctgcgggaggctggcgctcgggtccggctgcgggccacaggccgcggatcgcgttctgccagcgccccacgcccgcaagcgcggcccctccgccacctcgcggcccggcctgacctgttaatcacgtccccacggctcttctagcggggacaccgccgtctgcaggctccgtccccaccgtgcccagaccccgggaagtttgtcagtcagcaccctgatgccagccgattctcaaaaagccaggaggatccaagcagatcatttgccagacggtactgcagcaatggagatgaacagataattcacacagaaagaaggatggtagggagagacgtgcggggggtagggagggcggaaggaaggtctaggggaaggagcggagggggaagggaggaaggaaggcaggaatggaatgaaaggagaagggaggaaggactcgttgaatgcacagcctccccggtgctgcagcggcaggagcggctctcacaggcatggggcccccagcagaccctaccaggctgcgggaatgttgcggccctgcagggcgtctctgtcttttttgaggtgtctctggtaatatgtgataatgatagtatttttagacatttggaatgtgatttaaattctagctccaccaccttctagctgtgggaccctgagaaacagcacatcctcccagatcctcccttctctcttgtccacacgtggggaaggctcctggcggggtggggattgggggtggtgggaggggggaaggtggggggctttgcagatttaccaagctgatgtacaaagacctactacagctgtaagggctagctcctttctcccactctggcagtcactccactttgagaaacatacctcttgaaataaagctacaagtggagaggggcaggtgatttgggcaaataattccatactaaatattaggacaaaacatcctaggcaaatatcacaatccggagtcatagtggcatactaaattcaaccaagaaatatacccatgatgttgaaagagccaggcttatggaatgtaaacagcaaactattttattcttgttttctatttaccaattcaaacttgctctgcaggtcactcctccctgcccctgggataaaatctagggcatgttctgtgactttctggatcacaaaattcacatgatttttggatcattctcagttaaccaaaaatttgtcctgtaacttctagctataaaaataggctctgttcagcatttaaaatgtccaatcccatgtaggagtctaaactttcgatttcattttaagtttaagcttcctcttgattcctcccccaagcctggcccaggcttgcatttggcttcaggcattgggcgggtagcagtgtttcctctccatttttcactttcactcttccctccccaactagcttgcagggatttctgatcacctagtagagtctagaggcgtaagggaaggaggtcaccaaggggcaggccaggctttatgtgaatagtgctgttgtgagccaagtacttgagtacttcgaggtccccttctactgcagacatcttccctatggttcctgtgacccaggtttgtctcagagtggggttagcacacggtaccatctccatcccctttaaaagtatttattacatttttctggaaatggaagtctggaaattatatttccctgatagtcttatgagcaggattccaggttgattctgccaaatgtgaggcactcaggtgagactagaaagcagaaagatggtttaaaaaatcatcgttttcttcctttgactctgcacttacgacagcaggatgctcgagactcttgcagtaatttgggcaaagatttccacagtgcaaaatagaaaaaacaactggcaaatagctgtacaaattacagtccattttcatcatggaatgtcagtttggcaacaatggcatcgaggccccaaagcagctctgcagtaggggggttcctccttggtgactggatgggcacagccaagcacaggctcctgaagatcccagctccaggaaacatcagcatggttcattgcattgtccacctgaattcttcacccctccctgtggctgtgtccattgccctgtagtgttgcagttcccctcaggaaaaagatatcatttacttctctgacccttgatttggagcttggctatgtgacgtgctttggccaatgggatattggatgacacaacataaggagagacacagatatgcatatgcacaatgcagcttgcctttttatgcttctcccttcaccacgaaaagagctttccctgggggtagcagctgtccctgcagcctgtgttcagaatgcacaaatgtgaggagccaagcccagccagcttgaaagtgagttgccaggcccggcgcagtggctcacacctgtaatcccagcactttggggggccgagacaggcagatcacctgaggtccggagttcgagacgagcctgaccaacatggagaaacccagtctctactaaaaaatacaaaattaggcctggcgcagtggctcacgcctgtaatctcagcactttgggaggccgaggcaggcggattacctgaggtcgggagttcgagaccagcctggccaacatggagaaaccccgtttctactaaaaatacaaaagtagccgggcgtggtggcacatgcctgtaatcccagctacttgggaggctaaggcaggagaatcgcttgaacccgggaggcagaggttgcggtgagccgagatcacgccattgcactccagcctgggcaacaagagcaaaactccgttgaaagaaagaaaggaaagaaaggaaggaaggcagacaaaattagccgggcgtggtagcgcatgcctgtaatcccagctactcaggagactgaggcaggagaatcacttgaacctgggaggtggaggttgcagtgagctgagatggtgccattgcactccagcctgggcaacaagagtgaaactttaaaaaaaaaaaaaaaaaaagtgagttgcctaccctagctcagaccacctccagccaacccacagatgtgttagaaatgagtgcttatttaagtatggcattgacatgttgtgattagttgttatgcaccattatagcaaaaaaattgcacactgataaaagtaactgttccctcgttggcttcaccagctttcccaagaattgtttaatcccattccgtgtataaaatcactctctgctgagaatcctttttctgagaaaagaattctgagatttttttttctgcttgaggcagaccaacactcattccaagaacaactggaaaggctgaataaaacacagaaaacttttttaaaaagttttttgaaagcttcccagttaacaaacatttgaagggccataatctcaaaagaagaaaaacacaaggaggcaagctggccctctgtgaactacttttcctttcaggaaacgtgctgattttagctaagaggccgagcatttgggcagacggccatagctaagaggcagcaaagtcagcagagtcttcagctggagagacaagaaatggagactgaggttgtcaaggcagctggaactgaaggggccgagatatcatgtagaagggagacacagaaaaggaacactttccccttgaggcatctgctgaattaagctatgcagaaaggctatgaaaggcagcaggttttggcagtgtcatattaatgagataaaagttggagttcaggacccaccaaggaaaagaagcctaataatcacatcagacgctcagctggaatccttggaggaccacactctagatagatgggcaaaccagagatggagatgaagccttccaaaaactgcaacatagactctagtcagttcagtaccattggattaaggtaaaatcttcccactctgtctatcagatgacatggtaaaccctcccttgagacagacattgttttcagataatgtttcctggagccactaaaatttattataatggttagcattcaacaataagtgatcaaacacaccacaaaacaggaaggaggggaaaacagacacaacaaaacggagccactaatgacccagatattggtgttatcagacacagacttgatgggtggaatagagactttcatcaaagaactggaatctataagaaagaatgaaatggaaatttaaaacttaaaaatacaataactgaaattaagtacttagcatatgggttaactacaattagatttagcagaaggaacattctttgaactgtaatacaggacagaataaaaactctaagctgaaaaacagagacaaagagtatggaaaatacagcaaagaacataagatacttgtgggaagtggtgaacaggcctaatacatacgtaactggagtcttagaagaagggaggaagatggggcagaaggaacagttaaataaatataggctgagaactttccaaaactgataaagctttatgatccccaagcaggataaataaaaacaaaactgcatccaggcacactatacttttttattattattattttttgagacggagtttttctttgtcacccaggctggagtacggtagtgtgcgatctcagctcactgcaacctccgcctccccaaggtccagcgattctcctgcctcagtctcctgaatagctgggattacaggcacgcaccaccatgcctggctaatttttggattttttagtggagatggggtttcacatgttggccaggttggtcccgaattcctgacctcaggtgatccactggccttggcctcccaaagtgctgggattataggcgtgagccaccgcacccggcccaggcacactatacttaaactgctgcaaatgaaagacaaggaaaaaacattaaaagcagctagaggcaggtaggagggacacatttcttcttttcttttttctttcccctccctccctctctcctccttcctgcctccctcctgtcgttttcttttgtagagtgggggatcttgctctgttgcctgggctggttttgaactcctgggctcaagggtgctgggatgacaggcatgagccagcgcacgttactgacacattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcaggcagattgtttgagttctggagtttgagaccagcctgagcaacatggtgaaatcccttctctacaaaaaatacaaaagaattagccaggtatggtggtgcctgcctgtagtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgtcagcagatgtgcatacacaaaaaatactaaagggaattcttcaggtagaagaaaactgatctatgatagaatcacagaaatgcaggaaataataaaaaaaaacagagtgaatatgtgggtgaatacaaatgaatattgactgcacatagcaataataataatgtctcattaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactgaagaaattataaaagaatgtgtaagtagaaccaatggtagggggggaaacggaattaaaaaaataatcagaaagaaagcaacagaaaagaaaaaaataaaaacaaaaatgggtaagacaaatggaaacaaatagtaagatggtatttatgaacacaactatatcagtaattacaataaatgtaaattcacgaaatacacaaaagacaaaaattgacagacttgattaaaacaactctattcaagagacatgacatcattataagaacactgaaaattcaaaaataagggggaaagtgaaaaaaataccactgtgagtggtagagaaagccatttcacataataaagggttcactctaccagaaaacgtcaattttaaatgggtatgaacctaataacacaatctctaaatgcataaaacaaaaattaacaaaactcaaaggagaaataaacaaattcataataatagtggcgggctttagcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatgtaacagcaaattaatctaaattttatttatttatttacttattttatttttttgtttatacttatgtcatagtttatataaaaatataacagcaaattaatctaaattttatttatttatttatttacttattttatttttggagacagagtctcgctttgttatccaggctgtagtgcagtggcgtgaacatgactcacttcagccttaacctcctgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgctgggataatagatgtgagccactgagcttgacttaaatctaaattttattttattttattttatggccatgctccctctaataaatctaaattttaaataaataagtccaagtattattgtgtttatgtgtataaacctgtgcacacacacaaacgcgtacacaccctgctggtttctattacaagaatgttaagtttggtttgacattcaacagtcaattagtataagtcatcacatccaaagaataaaggagaaaaataaaattatttcaaaaggtgcagaataagtatttgagagaaatttaacctcatttgtaattaaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgctgaacttattagctctagtagtttttttgtgtgtggattccttaggattttccatagacaagattatgtcatgtgcagatatagttttacttctttctttatgatctggatcacttttatttctttatcttgtccaattgctcagcccctgcagtttggcaagagctaaataaggcataaagattaagaaaggaagaaataaaactgtcattcacagaggacatgattatacaaaaataatctgcaaattattataatttaaatgaatgtcacaaggccactcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaaaattgaatattttaatgatgtcaaatggcccccaaattgttctacataatcaattaaatccaataaaattctagcactttattttgtggaaattgactagctgattctaaagtgttttatggaaatgtaaagggcttctttcttctggagttgccttgtggacaggatttgagacaacccaggccaggtctctctggtccatggaaagcatgtgtatgctttttgccctgactatgtctgtagagaacaaccaaaacaacaacctcctccccatcagagagccagctagtctcttgccatttagatttttcagggatgagtcagagataccagtctactctgtcctgcagaaaaggatacttatcaacttttccacgtggccctagaaaagtcactgctagtcagaaatctcactttggaatgtgggggtggctggcatctatccggatgtcagatgaaacaggaacagttccactgtagtagcctgctctataaacacacagagaacccctattacatgtgaactatgaagctattagaaactacagctttgtggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggcgcctgtagtcccagcgactccggaggctgaggcaggacaatggcgtaagtaaacccgggaggtggagcttgcagtaagcctagatcgcgccaccgcactccagcctgggcgacagagcgagactccgtctcaaaaaacaaacaaacaaacaaacaaaagaaaatgtgcaagtgaaataagtgacaaaaagcaaacacaagatattctgtccatacgaaacactgcgaggcgacacttgtatttgtagattgacagaaattgcaggtggagttaaagaggtacaaactcagtataacattcattgcctcttttgctaaagttgtttcactgcataagaaaaagatactggtcgggccgggtgcggttactcatgcctgtaatcccagcactttgggaggctgaggcaggtggatcacctgaggccaggaatttgagaccagcctagccaacatggtaaaattccgtctctattaaaaataaaaaaaattagccaggcatggtggcgggtgccagtaatcccagctacttgggaggctgaggcaggagaatcgcttgaacctgggaggtggagggtgcagtgagccgagatcacgccattgcactccagcctgggtgacaagagggaaactctgtctcaaaaaaaaaaaaaaaaaaaaaaaaagaaaaagaaggaaaaaagagaaagagatagtggttccatgtgctgttctagttacgcaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcagggaggccttcacccagcacagtgagccatgccgacacttggtgcctgagtgtgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcacctgagattctggtccaaatcagggctgtgaggaccaggggctgggattccgagcccaggcagccctgcaggcaaggaggagggagtgtgtcggaaggctgtatggccagagccgctgaccgggccaggacttctttgtcccctcttctctcctgcatatcagcactcacgtcctcctggctcgggctggcctggcagctcggggagctgttggatgaaacgtccatgcgtgtggctgtggctgtcacgtgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccacgggtgtacatgtaggggcccaccaccactcagcccagctgctggctctctgcaggggagggagagcaccagtgtgctcctgagcacagaagccccgtccccagtgacctcctttcctccctcctcctccccaggaggaagtagcaactcccctcctctctgagtgggagctgacggcccccaaaggggccctgcctttgctctgcagctggaagggctgcttctccccctgggagattgggaggaaggagagccctgaaagactctctccttgagggccaccagctctgacccacacccttctgtggggccgtattaagtctaccttatgccaaagagctgagggaggaaagggcccctctagaaagaaggcctcggccatccgagagtacattcagcagtaacgttcactggccactgtggagaagggtcttaagtccaggccatgtggccagccacggcctgatggctctgtttccccagagtggcagtgggtgctggggtgtggggcagtgtgggagagctggctgacagaactcgcccagaaccccaaaggctcatctagagggcacgaggaaggtcagagcaccaggtccctgggctggtggcagccctggtccctcccactctctcgggtgatttgctccagaagagggcagcagaggcgattgcttaacctctttctttttcttttctttttttttttttgacagagtctcgctctgtggacaggctggagtgcagttgcacgatcttggctcactgcaacctctgcctcccgggttcaagcgattctcctgcttcagcatcccgagtagttgggactacaggcgtgcaccaccatgcctagctaacttttgtatttttagtacagacggaattttactatgttggccaggatggtcttgatctcttgacctcgcgatccacccctctcggtctcccaaagtgctaggattataggcgtgagccactgcacccagccaacctcttttttttttttgagacgaagtctcgctctgtcgcccaggctggaatgcagtggtgcatctcggctcactgcaagctctgcctcccaggcttatgccattctcctgcctcagcctcccaagtagctgggactacaggcgccagccaccacacccagctaattttttgtatttttagtagagacgtggtttcaccgtgttagccaggatggtctcgatctcctgacctcgtgatctgcctacctcggcctcccaaagtgctgggattacaggtgtgagccaccgtgcccggccctttttttttttttttgacggattcagcagcctcgcctcctgggttcaagagatcctcccgcctcaacctcccaagtagctgggattacaggggtgtgccaccacgcccagctaattattgtatttttagtagagatgggcgtttcaccatgttggccaggctggtcttgaactcctgagctcaagtgatccacccaccttggcctcccaaggtgctgggattatagatgtgagccagcatgcctggctgcttaacctgtttctagggtgccacagacagagctcaactggactaaagctgggcatgaaacccaggccttgggcaagtatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccgcggtcaggctgaggctagcggtatccagcttggtggcatcggccttgaagctgaaggtctcattgtacacagggttgatggagcccagcacagctgaagtcttcttgcacttgacaaacttgttgtggttcatcagagacactttgacaaacacacctagggaacagtgagcactagtgggctggcagaggcaggcgggagcagagcccctgcctgtgggaggtccggctaggagggcacgtgcccaagctaggtgccagggccccacccctcacacagtgctgcggccccgcgggcgtgaccagaggaagccggctgaggagtgcactgccctgcggcccaggcggggctccgctcccttccttttccttcctctttgcatcaggaaagtacccatggctcctgcaggccctggtttaccagagcctggcaccacaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagacgtgaacacaaacaggtggctgaccaccaccacctcactgggatgggtgggatgtgtggggtgagcccaaatggggtgggacatgtggggtgaaccaagccctccccctctgcagctcctgtattctgggttctcagaaacatcagagccacattttctcagggggcttccctgtctctccagaacccagctcccagcacccctcaggacagagcctgcccagctctgcccatgtcacttcactgacccccgcccctgccaggcttctcccacacctgcagggccagcacccaacatgctgagagaatggggacccagaaccagatgaacacatcaggggaaaccgaatccattctctcttggggtcctgagcctcccagtgacagaagatccaggagatgcgagtgggaggtcgccctaacaggatctaacatcatgctccagattgctgaagggacacagatcggtgcctcctctccttgactctaccctcctcactccttagcaccaggcctggctgtacatccctgccaaggtgcaactaagaccttcacctgcagctcaggggtgccccagacaggagcacaagaggaggctcatccccacccacaacccaggccggagcgaatctggctgctcaggctctgtgtctggcttctgccccaggacctgagcccatgtaaactcaggcttccttggcctgccctccccaggcccaggttctaaaggtgtgctccccaccacttccttgttgctcctccactttgtccctagaattacagcccagctctaggtgggactgtgaagctctgcccaatgctttccacgagtaatcagattcaggcccttgtgcctgaagactccttgtgaagactagatgacaccttctccaagagcagctaaggaatcaccttggctcctcaggctgagtatacatgttctgtatggaacttcagaaagaaatggtcaacattcattcctcactttaccagagaaagaagaaaatgtcacgtgcctttgattccctctttttaccaagactccactgagataaaactcctaacacagaaaccaacacatattctcaacactgggtacctgctggaggtcctgccttagccccgaagcctcaggtttccatggggacaggttggttgagaactggtggcctagctctcagcctgacacccaatagtatccccacccaggaggcagatggtagtgcaggcacaggttctgcaggctttcatctcatggaacgtatgttagagggtgtcctcgtcactcgccatgccccagaggaatcagcagggacatcaggactgagagaagacatggcacatctgacctcctgtcctggaaaccccacatctttctgactgtgccaatcacacggacaatatctagaaaagttctgctctgcacagtgttctgtctaccaggcccacccatctgaggacccagatgctaggaacacacagatactgaaggagcaaccacctgcctaaggtgcaggtacccctgcatccatctgtgggaggaagagcaagaaactaccatttatatggattctttggccctaagaatgaaccacctatttaggagtaacacagtgatgcagaatgaccagggagggtcattctcaaccatgctccctggtcattctgcatcactacaatacacatagaatccccagaatacacacctattaaagcctcaatattcttgcttcatacaaacatttgcttacagatcctgaacacacacaccgccccccaccccagtggtgtgttgctaactgcttaataaaatgctctccagggggaaataggaaagcctagaattgtgatgcttaagtggtgtaaatatctcagcatgactaattttaaactaccaacctaacgccactgaacacagagatgagaagagatgtgccatgcccagtggctaccccaagccagtacaagccagctccagcacagccacatcctttcataggaatatgtgtacacaatctacctgcaccctgagtaggacccacaactctcaccccaaatataaaaacaaaaccaaacgatgtacctccagaacacaacctcctcatatatcctgaacagacacacacaactgagataggatagggtggccatagcctccattaaaggagaacaaccttgctaaacagatgaagagaacaaaccatccgacagtgcacaaggaggtcctgcagtaaggaggtggaaaagaagaaggggaaatccccaaattcgcacaagtgtgaaaacccatgattagtgtccctgggttgaccagtgctcattataacagtgaaaaacacacccttgggtagagatttaagatgttaatgattcacctgatataggcactagcatgtgcagcatttagcgcatgcacgtccagagaacagtccagagagtgcttaacagtgacaccccttcccaccccttcatgaatagtcatgtaaggctcccataaaggaggtttccccagtgtcagtcaatgctgtctcacctttgagcagcccactctgatcggctgtcagagtgtacattcactttgcagtaacctctcttgcttacttttacgttggactcactctcaaagtaagacttcttttgtgcagcaaagtcaagaacctgaaccagcccaccagcaacacaactgctacctgtaccctaaatacacagatggcctgcaccaattattacttaaatttgcagacaaaactctacctgccccaaatgctcacctcactgctaaaaccatatatgtacatatatacgtgcccaaatacaaacacgtacaatgaacacagtacccatatatacccatatatagtgtgaaccctgaaagggctgatcatgagtggctaactgggcctaaactcaaaatggagccaagcagccatttgctgactgcaagtctcacacatttaccctgtttcctgcaaaaaccacgtacttgtgttactttgggactttcacagctgtctgttcctgtttatgtcacctgaatcaaggggtaccatttcatcatatggacttaagaaatagactgtgacttgcatcagccaatcagaaataaacaagcttgtatccctcatttgcagagtgaaccagatcgggaatctgagaacgaatttctctgtaaaagataatacctctctttgttctttcagagtgtatctttgttttgcactgaaggctgggactccttgatttgcaaacagctcagtggaatcaaatttctatttttttcttttgttattttttaaagaaaatccttttcagtagatttgttaacagtacataatgaaaatcctataggcataggctcaaaaaaaaaaatcacaaggtatacaacacttgtgtcatgcatcacccagaaaaagaatcacatacaatcccacagctctaaaatacaggaatccatgattcttgaatccaaacacaacctacacagcctctctgtttccaaatacatgcactgaacctcccacatctcccagaatacaaaacacagaagccacataaactcaaatacacacagaaccacaaactatttttatcaaatacatataagtccacctcacgaactctgagaacacacatacaagtggcaacaccaaattctgcgagtattacatttcacaacagacacagaggaccactaagtcttaatatacccaaaacccctcatatacacactcacaaactacccatgaatacacacctcaccctcccagataaaacccatacaatacaaaaaaaaaaaaaaaaacccacaaaaacaccaataatactctaatatacgcacacaactttcatatacccatgggcacatacaaactcacacaaatatccccaatccctgagtgtataaatcccccgaaacactatccaatcaatatgctacatctccagaatacaacctcctcacctcatcccctaaacatgcccaaacacatgtacgaacatcctagcattctccaaagaaatacactttaaatactaacaatcccgtattctataaacagacttagataattcatctatctgctgataaatatacacacaaaccagtatacacacccaagatgcacagaaatatctccagcatatcatttataaatacccataaaaacagttcccaatcccaaattatcccaatctagtatgaaccagctcccacattgccaagtactaaccaataaccatatcacatacctctaatacatataaattcaactctcccactctcctgtataaaaagagaacctcatctctctatcagacacacacatactaaattcccagaatatataaccctaataaccacttactgaaaaacacaagcacatagctccacaaaaccttcatctaaactgccacgcccttgaacacacccacagactcaatactcatgtatttgtctacatgccctaaatatacccgcgattaactaacacgccacaaatatgcaaacatgccacctcatatccccaaatacacatacagttccacaatacctgcacatatgtaatcacacttccaaatgctcacacagaaataactcctccatcttccaagacacagaatcatataaactccacctcataactgcacacattcatcctaccagtcccccagtagacatggatctgccctcacacattgaaatagccatacacaccccctgaaaatcatgaaaagaagcacgcatcaccatgcaacatgccccgagtatacaaatggtcttcctacatttcccaaatacgtaaaccaaacagagcgtacatccacaaaatagacacaagcactttctctgttattgcccatgtgcacaagataattcttccaaatctgccaaacattagacaaatacaaatcgccaacattcatctgagaaaacacatggaaaatacatcttcacaacccaaatcacaaatatataaccccaattcttctggtatacatatcttacatctcatattctccaaatataaactctcactcctacacactctcacaaaaacagttatgaccttcttttttagggggcggggaatggagtctcgctctgtcgcccaggctggagtgcagtggcacgatctgggctcattgcaacctccgcctcttgggttcaagtgattcttctgcctcagcctcccgagtagctgggactacagccatgcaccaccacacccagctaatttttgtatttttagtaaagacggggtttcaccatgttggtcaggctggtctcaaactcctgacctcaggtgatccacctgcctcggcctcccaaagtgctgggattataggtgtgagccaccgtgcccggcccagttatgacattctttaatctgcagtctccacacagacaccaccaacccacacatgtgaatacatattagattctcaccaattaaatacatatcaaattccaaactaagaattcatataaacatattttcacatacacaaaaccacccgcacaaatctcacaccctccaaaatccaaaataaatcttcctgacattctcaagtacacactaacccaaccacccaagataacacacgtgtgtgcagtaaattttagatacatgtgtagctacaatttacaaataatataccactactttttatttgtaaatcccacataagtaagcaattctcatggaagcttttcttgactttggccacactcttgcatccacaaccaacttgtgctaccaagtgaacaaactatgactaaaggactgttcttccactttgcagctgctcctatcagtgacaaatcagcgtattagaacatgcatgctggttgatcattctgatcaagtcaacaagcttcacaacttactcaatgaggtcgtccgtgagaacttcactgttttacggggacaggagctacttctttgctgaactgcatcacggtttcaactgctgaggttttcttcaagcttttgcattgtttggaatgtgaaaggcacggccgagacacactttgaggttcccactgcattgttacacctcccccctcacttcagggccaggtgagcaagggaaaggagtgcggcctgggcgtcccgcagggcccccactaggaaagctatgaacgctcccgccttgagcacagccacaggcctgctctggtcacaatgtggggtcgccccgcagacactggtgaccagtgggagcatgaccaggaggtgattaccttctgatcacccttggctttatttttaggtaacaccaagaaggacgccatgagagcgaaggccattgggtaaccaccctttgctctcgcgctgcgcgtctccctgccatcaaccgccactgggagcggttgagggcggccggcctcgcgctggaaccttgcccgcctcaaggctcctgcggcggcgcacggggcaggccaggagcccgccctaggagggccccgctggagatgtggaaatggagggacgcggcacctgggcgcttcctggggccagacaacgccccctcattggaacctccatgaccgtgcctctgagaaaccagcgcgtctgcgacgatcactcctaattttcggtaatacaaacctgcagtccatgcacttaggtaacacccttgctgaaaggtttacctttggagggtttatcctaaagcaaagtatcctcgaattgcatgtcttgcattccctttggatggcattgatttcattcctgctcatgcctttcaaaaaacagtatgccctgttttcctactcagtctggaggttccattaaagagtatttctggcaaagatttttagacctgaaaacacactccaaaatatactttcttctgactccattcccagagtttttcctaccgcattcaaatgatttctagaaatgtttttgttgtagccttgatcaatttcagtcgataaagcagcagatagtaagggaacaattccacgctccccacccctgactctgcaacacagtgcagaattccagttggcaataaaaaactagtagagaaggaactcactgacttcagtttgtaataccgtcagaagaaactttaatcgtcacatcctttctgctcatttgcaggattcctatcatctgtctccacgtgataacactgaagagccttcacgttgatgcaggcccagggcctcaagtgcagagactgagagctctgcaggacacagcatggagccgccattcctctatgggtggaagagcatgtgtcctctgaacaggggatccaagcactgagatattctttctcagctgtcagtgcggcccaggactttctgtggggatgctcagacagcaggggccggaggacttttagccaacacctaaaatggtcagtcttcacaaattacctttggctaatttgactgtctctcctcctggggtctaggacttcaaacatgtacagaagcgattgcagaattaagacaagacacttccacaatatattttttgtatcactggctcagaaaaagactcattcaaatcctgtatcaaagccacgtgtgagaatcttgagaaagcatcagctgactgacttgacaagggaggaagcaaccaaaaattctgcgcttcttcagtatctgagtatgatattttgcttcaacatccctcttagatgaagttattgattgaaaatcatttaagtttgccccatggtaaaagatcaagtcctcagaaagatctccaaagtgtttacggtttgttttgttttggtaagtttaccatgattttgcttgaattgctctccgttgatcttctcagctaagatggaggtagagttgcacagtagaagagggctgcatgtaagaaggcagttctgtctcagaggacaaaaggcctgggagcacccagacagacagtcactgcatggaggtcactcccctcccagtggccactgtggagacatttcacagaaatgcttgctggaccattcaggttcagagttgggacaaaaccgagaactcatggggatattggacaggagttaggaaatgaccttctcacacaactggggcagtgggggagaaccctgggcttgagacttgcaatccaccacttgcccctgcccctgcccctgcagtgtggccgctgttaccttttcctgcaactctgccttcttgagtccaaatgtcttcgaaaggggcaaatgcttcgtaagtgccgacagggtgtgtttcagtgaatgtttgcagtgtgcaccggtctggctgaaggcctcttcccttccccaacaccctcccatcgtgcaaaattaccctgcccagcagggagtgacttgtgtgtctcagaagattttgttgctgtgctctgagttctcactcctcatctcctttgaccagtttcttctaatactccccttgttcacaacacagaacatgagtgctctttcctatcattttgacactaataaacggacagtgattctcagtgtggaaatgagaatgaagttttttttaaagacaggctacaataattcccatgcagagaaccacatgcgatgacactggattccaaacagcaagaacgtatggtgaagatgaggccaacagtgagctgagagaggccagccagggtgtgtttcagtgaagatgagaaacaatcagataacacctgtttcctccaggaaagaaaatgtggccagggaaaagagatgggaggaaggctggtcattgcctattccactgtgcacagtttgaatttggagccatgaaaagtattgcttggttaaattaaaatcattcaaaagataaaacataaacatttaacaccagcacaatatgctgggaaacaaaatgaaaggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccaaagcccttcacagaatgtcccccacccctaacagctgcccactgcccctccccctctgcagaatgtctggggtcctatgttccaggaacctgtttactttcaaattttccctgtttcagttggactcaggagcatctggtgagccaggtcactctctgggtcttacccttggcttttctcattgcggaaactgccagacagcggtggtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacgagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaccctccccagcacacctctggtgacagaacaggatggctgcggcccgagtggggccggggcttccaacgtctttgtccagatgaggacagaggtggggcctgtgaaggccgctcaggcgcagaccttggtcctaactcaggcccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctcggggcattggagctggtcctgcagctcacacgtaaagaggctgctggatggacgggaggtcacgctgttcaggggagcttgcagggcggttgtgagggtgatgggctgcactatgggaaggtatatttttgaccatattaatctggctgcggctcaggacagactgtcaggggcctcatctcaactgcccgtcactgtcccgtgagtccagccaatccttactttcaataattttcacaacaatgtttacagaagacccaggtcagagagggttcctggtgtgacgtgagctacggtttgggtttaggtctttgagtacacgccccagtgcctcccctttaacccagtattgatggccaggagcacctcacatggggccggggggaggagctgcaggacccagcaggaacctgacacatgcccgcagttccgctgaggtccagttagcacagcggtggtggagcctgcacagggggatggtcttgggccctgcactggggccgatgccgagcaggtatttgcatcttcaccctcaatccctcctagaaaaagggacaatgatgcttcattcagaggatggtgaagagataacttgagctcacatatgacatgcatagcacagtgcctggcacatgctatgacacattacatgacagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagatcgggtgtctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacattggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggcgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttccctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccatggatttgagtatctgtgtatgtgattgtgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccctgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggctgaatggggagggcaggaagggagggtctggggggaaggggctggggagtgggggtgggaagcagtgcgttgggggcctcgtgtgtaagtgtgaataaatgtagttgtcttggaaaatgctcttggggctgctgcctctgtcctcggtgctgtgctgctctgtggagggtgtctgtgagggagggcagaggaaccggcagatgccaggctctgggaacccacaggggccggccccactctttcctcctgacgtagggagccccttcagatgctccagggactgacagatgctgaggaagccctgatccctcccaccacccactcacaaggccctgcctgctttagggaggcttcttggggcccccccatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggtgtttctgctggttccagggcccggaggagctggggcccaggccaagaggggccgagggtctgccgcccttctgccaggcacagaccccaagggcagagcaggggctgcctgggatgtggcattggctgtctgggaagtgccctgggagttgggggctaggtgttcgccaaagagagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctactggttaccccactggctgttgtctatcctactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacaaggacacagtgagaaggcggccatctgcaagccagagagagagccctcaccagaaccttgcccactgggatgctaacctcggacttccagcctccagactgtgacaaatacatttctttttttaatatgtgccaccacccccaagtctatggcactttgtcctagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacgtgaaccaggagagcctgggacgcagtgagttgtgcttcagttaatgtagagaacttcactgaaccgcacataaccattgaagtaacctgctgtttacagtctccatcatgttctgccaagagagttattttacagtgacaaaacttctcttctggtgccctgacacatcctaggactttgatgctggtaattctttccccccagcaaattttggttctaaatccacagaactacttgagaaactagatgcaaaattgtagtaggtttaaaatatcaatactctttttttttttttttttttttttttaggcagagtctctcgctctgtcacccaggctggagtgcagtggcgcgatctcggctcactgcaagctccacctcccggattcacgccattttcctgtctcagcctcccgagtagctgggactacaggcgcccaccaccacgcccggataattttttgtattttttagtagagacggggtttcaccgtgttagccatgatggtctcgatctcctgacctcttgatccgcccgcctgggcctcccaaagtgctgggattacaggcgtgagccaccgcacccggcctatcaatattctttatatgttttgctattcccatttaaaagagggaaactgtagctatacactttctagtcatgttctttggtgattttcctgcacaaaccaacattgttcttcagaaatataatttcccctagaattaccctccatccaaaacatattgttattctatcacagagataaataatggctttccaaatcctggttaaaaaaaccaaacactctcttcttctctgtatttttccagaacaggcatagatgatggcaattgtgttttaccatctttttttttttctgagatgttagttttctaggatatggaaatcttaggattcataaaaaatgaaacaactttttgaaatgttagttttccaaaattggacaatctttttgagccattctatttttaggactattcgttagctgactttagagcctttaatgtttcgttattatttcaaacaatagagaactttactcccccccaaattttgagacagggtctggctctgtcatgcaggaggctgtctgtagtgcagcggcacagtctcagctcactgcaacctccgcctcttgggctcaagtgatccttccacctcagcctcctgagtagctgggactgtaggtgcaggccaccacatctggctaattttaaacaatagagaacttccaaaacaaaagttctttattaattcttcaagaaatctgttttttacttagtcgattaatgtccatctcatgttgcctcaatagcccatgtatgaatcactcttcttgcagattttgttcagttttgttgtatgtagacccatctttctttgagttggtttctttgattgagttgatttgtctgtattaaaacccaaacaatacctaagccaaaaaagcaatgtaggcacctgtgaactcacacacttggttgcaattgcttcagtaaaaaggacagtttacactcaaattgaagcaaccattatgtttccacaaacaacattccttattatcccacctcaccttttcattcttcctatgctgtctaatctgattctgtacaagagataaggcaggtactgctaaatgataacttagatgcaggggccatcatgaaaatattcatcccatatcttacattaagcaaactactagcaactgtttgttaaaaagtataaatgaataaatgaaaataggacagataggcagtgtgggaagctaaaatatggaagtgttattgctttgctttatgtggtataatgatctgattttatcttcccagctctcccaggaagtatgcagaataatatttatctcatattgtgggtgtggcaatcaagacagagaggctagatgctttacctaaagtcatccaacaaatatttggtagaaccagtgctagaatgcaataaatggaaacagagtttatttcggtgtttcttttcctgatacttgccctattcctgacaaatgaataatggcttcagaaggtgtcacttgttgctagggctaaaaggataaattttacctgtaataccgtaccacttactattagttaacgacccagtatttattctctttttttctttggaatctttggaatgtgtaaatatttgcctcccgggaagctcactttatcctctcctcaggaaaaaatcctgatttggtctgaaccaatcttggtaactatctttcttgccagttttgttttaggaatgggcacgcaactcagttctagccaacgagatatgaggagcagtctactggggagtttctgggaaagtttgtttttcttgtcctaataaacaaacaaataatggggtcactggattggagatcctattgagtcaaaggaatattgaatttgacacagtagaatagtctggaaggaaaggaaatgatattcagtaaatgaaatgctgaaaattgatattatgaaggtggcgcagtagttgttattgattaaatgaaacagttgagattaagaaagtttagccaggacaagttatatagcacaaatcatttcaggtaaggaagttaaaaaaaaaccctgagaggctaggaagtcctggctccaaactcctgctcctgctggacttgagccccactagcttctcatcttccactaatctatgcacccctcctttcccactcctcaaaagccgagctcactcaacaactttaattttattcaaataaattatttacacagacattttgtttttagtagatgttattagtgattaggaaaaatgaaagagattgacatctttcaattgacagagatgccaataattttaagtataattttttaaacactttgttcttaaaatgagaaagaaatgtaaggaagggatcactagcctgggcgttagcatgtccgaatatgataactaaacctgctgcaattatcttgcaaccagggaggagctagcttgaaaataaagccaacacagatgacaagcagaaagtggaaagaacctaagtcgttgatgatgctattgagctgatgaattaaacctggagtgtatgttccatgggcttctgtaaggaattaaaatatttttactgtttaaaccagtgtttcattgttttctgcagaaatcctaattggcataaagaaactattgaccgactaaccccactgcaacctcacctgaccccttaggatgtcctttcatgattttcttgattttgttgaagttacgtattgagaataatggaaaatcacagaaggtgattttctgatcccaactccttagctatgaccttgtgtctctagctcatgatcatggtttatgaagcacgggaaggactgggaaaagtagaaagtaggtaggtaagatgagatgtctgatgatggaggttattggggtcaggacaggtggataggcaagttgaagtgtgtaagctaagcaggaaatgcaaatgaaaatcagagagaaggtaccccttcagaacagattcttagaaagccattattagaaacatatgggccacatctttgagaaaagttgtggaattcacattacagtaatggcatcacttagattcatgctcttctctcagggagagaaatcaatatttataggatatcaaagggtcttcatcatgtgtctcagtctgtttttattgctataaacaaatacctgaggctgggtaatatataaggaaaagaggtttatttggctcacacaattctgcaggctgtacgagaagcatggcaccagcatctgcttctgttgagggcctcaggaagcctccatcgtggtggaaggcaaaggggaacccgtgtgtcacatgatcagggaggaagagagcaagagaggggaggaaggtatcagattctttttaacaataagatctcacaggaagtaggagtgagaacataatcccatgaagacagcaccaagccattcatgagggatctgcccccgtaaccaaaacacctcccagtgcgccccacctccaacattggggatcaaatgtcagcatgagatttggaggagacaaacattcaaactttatcattgtgcttgttttcttcagaaatagaccgaattgatatgtttcatgatgacattatgatctaaaaatgagagtttatttcagtttgtcctgtatacacccaagaggtccaggatattattctgtctgtctaccacaagtcctgcaaactagaagatggccttaacagtcaatctagggtggttctgcccaatgaccttttgtctttcctcagtgtcttccaaagcacatagtaatattctatcatgaattatatgaaagctgtttacatggattaaacagtaaatctgacaaacaggctgctttttgatgactctagacatatttcttcttacattttagacatttgagaaaaaaagtcaaatttcttaatactttatgttcaattgagtttgaagccataaagaggaaggaaataataaggattagagcaaaaataaatgaaatagagaatagaaaaacaatagaatcaatgaaacaaaaaattagttctttgaagagatcaacaaagttgacaaagctttaactagattaaggaaaaagaatactcaactactaaaatcagaaatgaaagacactactactgatttataggaataaaaaggattgtaagagaattcgtataagagctatatgtcaaaaaattggataacctagatgaaacagacaaattcctagaaacatacaaaccaacaaagttgactcaagaacaaagaataaatctgaatagatctataaaaagtaatgatattcaattctgattgaatcagcaaccaaaactctcctaacaaagaaaagcccaggaactgatgacttcgctggtgaattctaccaaacgtttagaaatgaattaacactaatccttctcgaactcctccaaaaagttgagaaacagaaccctttctgagtcattctatgaagccaacattaccctgataccaaagctagacagacaatacaagaaaactatagccaaatgtcccctatgaatgcattatagatacaaaaatccccaacaaaatactaggaaattaaattcagcagcccttaaaagaattttacactatgaccaactgagatttatcccagaaatttaagagtggtttaacgtatgaaaatcagtcgatgtaatacaccaagtaatagaatgaaggagtgaaaaactcatgatcatctcaattgatatagaagaacatttgagaaaatccattcctcctttatgatagaactgttcaacaaaccaggaatagaaaggaactgtctcaacatgataaagaccatgtattaaaaactcacgactgacatcattctcaatggggaaaaatttcaagcttttccactaaaatcagaagccatggatgcctgtgtttgccacttctattcaacatagtattggcagttctagccagacccatcaggcaagaaaaagaaataaaataaatccaaattagaaaggaagaagtaaaactatctctatttgcaagtgatataagtgtagaaagccctaaagaataccaaaaatagcctcttaaagctaataaacaaatttagcaaggctgcagaatacaaaatcaacacacaaaaatcagtcgtgtttctacacactagcagtacaaaatctgaaaaggaaattaagaattttttatttacagtagtacccaaaagaataaaatatttagaaatcaatttaaccaggaaggcagaagacttgtacactgaaaactacaaagcattctggaaagaaattaaagtagacttaaataaatggaaagagatcctgtgttcataagttggaagacttaatattgttaaaatgacaacgctactcaaaatgatatgtagagtcaatgtaatcacgctaataaaatcccaacagcgcttttggcagaaatggaaaaacctattctaaaattcatataaaatttcaaggaacccaaaatagccaaaataatctgaagaggaacaaagttgtaggactcacattttctgatattaaaatttactacatagctataataattgaaatagcatggacttggcacagaggtagacaatatagaccaatggaatagaatcgagaggccagaactaacactcacatctatgggtaattaattttcagcaagggttccaggatcactcaatggggaaaaggacaatctcttcaacaaatggtgttggggaaactagatatccacaagcaaaagaatgaagttggacctatacttttacacaatgtacaaacattaactgaaaatggatcaaagaccaaaatttaatgctataaaacacttaaatattaaatgctataaaactcttagaggaaaacatactgaaaaatcttcatgaccttgggtttgacaacggtttcttaaatataacatcaaaagtacaagtgatgaaacaactgataaattggacttcatcaaaattgtgtatcaagtgacactataaagaaagtgaaaagataacacaaaaaattggagaaaatgtttgcaaatcatacatctgacaaaaaactaatatactcaggcatttctttatggcaatgcaagaatggcctaatacaatacccaaaagaattgaatgcataaagaatcctacaactcaacaaataaaagataaataactcaattttttaatggacaaaatacttagacacttctctaaaaaaaagacatgtaaatggtcaataagcaactcaaaagatgctaaaaccacaatgagataccactttgtacctactagaatggctataattagaagaaaaaataactagtgttgttgaacatgtggagaaattggaaacctagtatactgctggtgggaatgtaaatggtttaactgctgaggaagatagtttggcaattcctcaaaacgtaaaacagaattatcacccagtaattctactcttaagtatataccggatatagtttgactgtttgttcctatgcaaatctcatgttgaaatgtaattaatctccggtgttagagttggggcctggtgggaggtgattggatcatgggagtggtttctcatgagtggcttcaccatctctagctgtcatcaagattgtgagttctcacaagatttgattgtttaaaagtgtgcagcacctccccacttcctctcttgctctggcttttgccacgtgacatacctgcacccactttgccttccatcatgattggaagcttcctgaagcctccctggaagcagatgctgctatgcttcctgtacagactgcagaaatgtgagccaactaaacccttttttctttggcacttacccagtctcaggtatttctttatatcaatgcaagaatggcctaatacaatacccaaaagaattgaaaacaacaacttaaacagtgacttgtacactaatgttcatagcagcattattcacaatagacaaaaggtagaaacaaccaaaatgtctatcaaaagataaacggataggccaggcacgatggctcacgcctgtaatcccagtactttgtgaggccaaggtgggcggatcacctgagttcaggagttcgagactagcttggccaacatggtaaaaccctgtctttaaaaaacaaacaaacaaaaagataaatggataaacaagatgcagtatatacatacaattattattcagccatagaaaagaagaatggaatactgatacatgctataagatggatgaaccttgaaaacattatgctaagttaaataagctagacacaaaaggatagtgtatgataccattatgtgaaatatttacaataggcaaattcatagagacaggaggtagattagaggttaccagaggttaccaggggctggaaggagaggaaaatgggagtttttgctgaataagcacagtttctatttggggtgatgaaagggctttggtaatagatggtggtaacggttgcacaacattgtaaatataattaataccaccaaattgtacagttaaaaatgattaaaatggcaaattgcatatgtctttctccgtttgtgttgctataaaggaatacccaaggctgggtaatttataaagaaaagaggtgtatttagcttatgattctgcagattgtacaagaagcatggcactggcatccacatctggtgagggcctcaggctgcttccgctcatgtcagaaagggaaggcaagccaatgtgtgtggagatcacatggtgagagaggaaacaagaaagaggggggtagtgctaggctcttttaacaactagctcttggccaggtgaggtggctcatgcttgtaatctcaacaccttgggaggctgaggtgggagaatctcttcagcccaagagttcaagaccagcctaaaaaaaaaaaaaaatcccataaaacctagctctcacaggaactaagagaccaaaaactcactcacctgcaacccagggagaatattaatctattcatgagggatctgccccatgagccaaataccttccattaggccccacctccaacactgggtatccaatttcaacatcagatttggagggtcaaatacctgggctacatacccttgtctctagaaaaaatatataaaatttagctgggtgtggtgacacatacctgtagtctcagctactttggaggctgaggcaggcggatcatttcggcccagaatttcgaggctacagtgagctataatcaggccactgtacaacagcctgcaagacagaatgagaccctgtctttaaaaaaataaaaataaaaataaattaattacttttaaaaagaccttgtattgcaagttggtaaacataagtacatttgttgggactatgaaattattcacccacaggatcaatgttacaaattggtatttgcatctcaatttagtttgttcaacccagaattcacatttgccataaaactgtagtcaataattcaattaaactactgataaccaaaggggaaagcaacatattgaatcaaaaatagttttatcaactggtgtcaccaaagaaaagcaggtttcactagtgttgagaaaatagaaagttttctattgattatggagaaatttcagttcagtttctagaaggttaaatgccccaattttttttttaatgactgggttaaactaaataatggcctccattatttccatatgcaaatcctcagaacctatcactgttacgttatatggcaaaagagaatttgcaaatgtgattaagtcaaggatcttgaaattgggagattatcctgggttatctgatgtccccaatgtaatcacaaggatctttataaaaaaggaaatgtgagacaaagggagagaaggtgatgtgatgaagtagaggtcagagtgatgcgggggctagatccaaggaatgtgggcagcctctagaagctgagacagacagggaaatggattctcctcctagagcctccagaaggaaagcagccttgccaacccatttgaaacttctgatctccagatctatacaacaatacatctgtgttgtttttttttatttttatttttttagggacaggtcttgctctgttgctcaggctagagtgcagtggcatggtctgggctcactacagcctcaacctcccaggctcaaatgatcctcctgcctcagcctcctgagtaggtggagctacagacatgtgccaccacacctggctaattttattttttattttttgtagagatggggtctcactatgttgcccaccctggtctccaactcctgggctcaagcaatcctcctgcctcagcctcccaaagtgctgggcttataagtgtgagagtcacagttcctggcccatctgtgttattttaatgtttaagtttgtcataatctgttacagcagcaataaaaaactaacaaaatgactaattttacttccaaacccattgtctccctcccttaaaataattttatcacaatagctatttttatattacagtcacacaccacataatgaccttttggtcaatgacaaacttcatatacagtggtagttccttaagattacagtggagctgaaaaatttttattgcccagatatgtcagagctgatcattgtacaacacattacttacatatttgtgatgatgctggtgtaaacgaacctactgtgctgccagtcctataaaagtatagtacatacaatatgtacagtacatggtacttgataatgataataaacgactgcgttatgggtttatgtacttgctatattatacttgtcttattattttagagtgtcttttttatacttaaaaaaaagttaactgcaaaacagtccttcaggaggtgttccagataaggcatagttaccataggagatggcagctccatgcatgttactgctcctgaagaccttccaatgggagaagatagggaagtgaaagacagtgatattgaagaccctggccctgtgtaggcctagtctcatgtgtaatgtgtgtttatgtctttttgttttttgttgtttttttgagactaggtctcactatgttggcccacgctggagtgcagtggctgttcacaggtgcaatcatattgcactgcagccttgaactcctggccttggacaatcctcccacctcagacttctgagtagctgggattataggcttgcaccatagcacctggctatgtcttcatttttaaacaaaaaagtttgaaagtaaaaaataaataaataaaaatttttaaatagaagaaagcttataggctgtgtgcagtggctcatacctgtaatcccagcaattagggaggctgaggcaggcagatcacttgaggctaggagtttgagaccagtctggcccacatggtgaaactctgtctctattaaaaatgcaaaaattagccaggcatggtggcacactcctgtgtcctaagctgctcgagaggctgaggcatgagaactgcttgaacttgggaggcggaggttgcagtgagccaagatcatgccactgcactccagcctggacaacatagtgagactctgtcttaaaaaaaaaaacaaaagaaaagaaaatgaaaaagaaaaaacctcactgtagcctccacctcctgggctcaagcaatccttgcacctcagcctcctaagtagctgggaccacaggcacacaccaccacacccagctaatttttttttttttttttttttttttttttggtacagacagggtttcatcatgttgcccaggctggtcttgaactcctgggctcaagagatcctcctgcctctgcctcccaaagtgctgggattacaggcatgagccactgtgcctggcctaagtgtaccactttatatcttctatagtttacttttactgtaccttttctacatttaggtacacaaatattgaccattatgttacaactgcttacagtattcagtacaataataggctgtccaggtttgcagcctaggaacaatagacaatgccatatatagcctagatgtgttgtagactataccatctctgtttgtgtaagtgcacagtatgatgtttgcacaacgatggaatcacctcatgatgaatttttcagactatatccttgttaagtaatgcatgaccttaatcaggaatgagtcacagcaatactgtaatcttgatgaagatgttgatgtagataatactcccatttacaatgcacttgccaaatacaaggcattgcactgaaagctttacagactttattttaaaaaattttacaaccttttaggtaagtaccattaaccacttttacagatcagaaaacagggtctatgaggtgaaataatttgtcatacagtggtgatgtaaatatgcatataatgaaacagaataggcaagtcagaagtgatttttgtatttcttttaatagattaagggtacttactatcagcaaaagagtgaaagtctgacagaaaagaaaaagatggaaagaaatgtggggatgtgcaattccttatgttggttggttcagcagagctttgccattgttcagatggagtttaggcaagcaaaagacgaccagccattgctgggtatttgaacatcagatgttcataaggcttaggtattcttaaaagaaaaatttattctcttaaaaattctgaaaaaaagttctctgtattaaaacttcataatgaacattgccacattgtatattaggcacagatattatttgttggagtttttggtaattgttatttttgtaactggaatatttaatatatgttttatatatatttattttatttatttattttttgagatggagtctcactctgtcgcccaggctgcagtgaagtggcacgatcttggctcactgcaacctttgcctcccaggttcaagtgattctcctgcctcagccgcccgagtagctgggactacaggcacgtgccaccacgcccagctaattttttgtatttttagtagagacggggtttcactgtgttagccaggatggcttcgatctcctgacctcgtgatccacccaccttggcctcccaaagtgttgggattacaggcgtaagccaccgctatatattttgcaaacaatagcaaatctagaggaaattctttgaagtaagaagcagtggtacttaaaactggctacttgtatttatcatctctgtttcagttttttaagaaattcaaaatttttacagagagttgataaaaacatttgatgatttggggtgcagatgaaggatggctggtatttgaaaaataaataaataaaggccttccttgattcttaatgttgagactgaaggcttcattggagtttcttcctcagcctgaattccagtgataatgtgtctgttcttgacatgagcaataactggagtacttaggattaaacaaaatattagatgtgccgggccagaggaggtgaggaaagtctaaagtgataaggtgctagtcagctcagagtggctgttttagatagtgtaatacagcagactagaaacttgtcggaaaggaaaggtaccaggcaggagataaatgtacacccaccttagctaatgtaaggagctgaaaactctattttgaatttttatcctaaacatggaaataacatccttatgagaaattgaacactaaatagacatattaaaccaattttgcttattgagacatctgttcattcatttattcaacagctatttactgagtggatacttggtagtttttaggccttagaattaacccaagacaaacttgtgaggtaggaagttgcatctcagtcatctcactactttgctctttcttgagacttcagccttccctttcctccctcaggttttggagcttagaaattaataatattaaagcttcaatgacaagactgtttaaaataaaaaatggttgggctgggcacggtggctcatgcctgtaatcccagcactttgggaggctgaggcgcacagatcacaaggtcaggagatcgagaccatcctggctaacacggtgaaactccatctctactaaaaatacaaaaaactagctgggcgtggtggcaggcacctgcagtcccagctacttgggaggctgaggcaggagaatggcatgaacccgggaggtggagcttgcagtgagctgagatggcgccactgcactccagcctgggcaacaaagcgagactccgtctcaaaaaaaaataaaataaaataaaaagtaaaataaaaaaataaaaaaaaattgttgtgttcagtgggagataatgtgttaaggaaagaaagatgttaagttctactacttgtagataggtggaattattgtgtcctttgtattgtttttgctttcctgtcataagatattccttggtttaataccataataaatacataaaaatacacataagaaactaaacaataaaaagaatgtgttaaataattttttttttttaccatttcaggttttttttctttctaattcagttaatcagtcccgctttgcttgtttgtcaaggttcttcaacttgcttaaaaactttttcaaattggtcaaaaattaatctttcaaattactacaggcttacaaaacttttatgcaccatgcaaacatcatgagatgtagtatgggaggtaaggaatatttaacctgcttcaaactttaagtattggacatttggattgttttccactttaccccgttaccgacaaagtggagcagacataactgattaatatttttaaccaaatattttgacttaagtatcgaattcctttggggtcttgaaggatataatacactatgaaagaaaagtagaaggtgctgatgatacaacgaattaggaggacctattttgtcgtgggaactttagagaagactttttgaagaagagtcacatgtcctacctcaatcagtctacaagcgcaaggaaacaacttagagttcgacaaagtcatatttatagattcattgcagtgagggagatcacacacagaactgtgaggcatctcactcaccaaacaaggacaagataatcattacaggatttgggggaagagtagagtttgggtgagatttaaatgaaaccatttaagtggcttttgatgaactcaaagcaaatcaggagtcaacatcaggtctgggcaggatccaggggtctgcttccttgaaaactagaaagttaagacagatatggattattgtgtccagaagcccttttcttaagctctgtggctggaatggaaatggaggctgattctctgtgtcaaagtgttttagagtctccaagacactatgatgttttatgttataataatataatttcaaagaacaaagtttcttagcaagtaagaaaacagtaatcactcaaagaatggggttgttatgaagctttatcgcatgtctttgggataactagtttcccgtaaactttgcagctagttttatcaatgtttattaatccagcttgatgagtgatggaacagatttttactttctaagtcctagcaaaagctttccctaaaaagagaggaccaaccaagagacaggggaaaataactttctggaaagaacaaaaaaacaagcatgaaggttgtgagctggttctggacacatttaagaccctaaaaaccaacaggacaatgacacaggcaacaaatgatttgaaatgatggagagataggggcagatctttcaggaagctgctagccttagttaggattttgcatttcatcaaagagtagagggaagtcactaaaggattctaatcaggggaattaccgaatcttcatcttctaagatagagaatgcattgtcataggcaatagtggaaggtagatgaccgtttggaaagttgttgcaagagaggatgatagtttatactagggtggcagcagtaaagaaggcagaaatggagagattcaagacaaaattttaggtagaaccaaatggtcttagtgagagtttgaatgtgtaacatgagggagatggagtcagggataatatccaggttctggcttgaatatccgagtagaaggtggcatcattaggatgtggaagactggaggtgaggcaggattgatggaaaagaacaagtacagctgtagacatcttacatttgtgcgacatttaagtaagaatgccttgaaagcatttgggtatttggatctgaggttgagaagagaggattgagttggtgctaaatatggagtcataagtatatattcaaagccatggaaaaaaaagtaacatgagaagagaaaaaggatcaggaccaagtctaaaggaactaccaaatccagaggtgaacaggaggacaggagccagcaaggaagcccaggcaccatgaagatggctgaattcacttatgaaaagcttggtttgatgctttgatgttaactcagttgtacttgtcatcaatttcttagagaatcgagagctgaaacatattctgaactgccttctatttttattcactgctttgtattatctgtagtcatctagttagacaattcctttcctgcaatgcctgtgatggaagccaggaagcatttatttctttgcgaagcatttggaaaatataaacatggccgggcgcggtggctcatgcctgtaatctcagaactttgggaggccgaggtgggcggatcacgagttcaggggatggagaccatcctggctaacacggtgaaaccccgtctctactaaaaaaatacaaaaaaattagctgggcatggtggtgggcgcctgtagtcccagctactcgggagcctgaggcaggagaatggcgtgaaccttggaggcggagtttgcagtgagccgagatcgcgccactgcactccagcctgggcgacagagcgagactctgtctcaaaaaaaaaaaaaagaaaaatataaacatgcaaatgacatcttatcacagcactgaacagatgttttaaattgtatttatttatttattcatttatttatttagacgaagtctcgctctgttgcccaggctggagtgcagtggcgcgatctcggctcaccgaaacctccacctcctaggttcaagcgattctcctgcctcagcctcccgagtagctgggactacaggcacgtgccaccatgcccggctaatttttgtatttttagtagagacagggtttcaccatattggccaccgtgttggccaggctggtcttgaactcctgaccttgtgatctgcccacctcggcctcccaaagttctggaggcgtgagccaccgcgccaggccatttttaattttattttaagcctgtgttctaaccacatcatttacctgcaggtccttggatacaatatgtacttttgagtctgagtctgtgctcacgttgttccttctgcttagaatggcctctctttccccttctctacctaatcaagtcctacttaacttttaaaacccagctctagtggcatgctcctctctgagccttttgttgttctaataaggcgtaactaatcactcctcctaaatacactcacagtatccagctcattccattagtacagatcttttcatgttttactttgctaaggtatagacaaatatatctgtctctaccattggactgtaaggttcttaagtgaccatgagttattcaactttacgtccctcatacagagaacaaatcttgttgaatttacttgcatgtaattggagatgacatggcaaagaataatgtggatatatcctgctcagcttcagataaacgctatgacatatgtaaacaaaatattcagctaacttttaaactttacatccaattttgacttatataggatgtaaactgcatacatgtacatatgcttcagacctttgaacatgctgctttctgtctggcatatgcccctatcttctctctcccacacaagtccacccatctctcaattttagtttataggctttttttttttttttttttttgagacagattcttgctctgtcgcccagactagagtgcagtggtacgatctcggctcactgcaacaaccacctcccagattcaaacgattctcgtgcctcagcctgccgaatagttgggattacaagtgtgtgccgccacgcccatctaattttttctatttttagtagagatggagtttcactgtgctggtcaggctgatcttgaactcctgggctcaggtgatccacctgcctcggcctcccaaagtaagcccggccattttttttttaagagataatatctcagtctgtgacagactggagtacaatggcgctatcaattttagttctaactaaactgtcaacaaaatctttgactaccttctctctctacctcaagatagcttgctcaattgcaatgtcaccctgcactctcattttacaacacacatcatcttttagtttctcagtaagtgttgctttctctctacaactgaaagctccaggaggcagggacaaaacctgtagtttttcttttctttttttcttttttcagcaaagggagggctgattttttaactttttgaaaatagatgaaagtaaacaataaaataataaaacctcacatgccatcgctcagcctcagtaaccatcaacccatggccaatcctgtccctactgcaaccctgcccattccctacactcacacattattttgaagtaagtcccagacaacacatgattttatttgtaaatatttcagtctgtttctgaaatgactcctttttgtaacataaccacaatgtcattattacacctaagaatgaataatatacctctttaatatcatcaactatccaggcagaattcagatttttaattatctctttcagacaatctttttaatgtcttttcttgaatcaggatacaaacaaggttcacacattgagattggctggtagtctattgtctctttttacctaccgattcaccttctattttttctttttgtttcatcacttataaatataaatactatttttttaatagctatgtctccagttcctcacccagtcttggtcatagcaggttttagataaatattgtatttgatgaataaatgaatgaatacaagtaatgcataattgagaaatctcaggagataccaaaagaaatgtaatttaataataatctttgatttctctgatctcatatttcttcaatgttctctaaatttaaaattttatttgatacataataaatgcatacttttgaggcagaaagtattattctctgaaacatttctaagaaattaatttaccctggaattgtcataattagttaattttaactacttcccctatataaaattggtgacttgggcagcaagacaaaaaaggtttctattgttaagtaagacttatttttcttcctcaagaaatcatcactagtaagcattgcaacctttactttgctattgttagatgtggcaacaactcgtgctggactcgagaaaattgtgcaagcttgaattaaataattgcttctaaatttgcttataaggaagtttattgtcttaccagggactaacactacaaatatggaaatggagtcaagcagtgattcaatgtagataacataattggaaactgggagaaagaatgttcattcaacaatcgagaaaaactaaaataaaagttaaactttacttcatcaatgctgggtccaaattaattaatgaaaacagaaataaaactatgcttcctaggataatattgacagtatttttaaaagtttattattttttaaaaagattattatatgaagagtaaaagtctttctatctctctagcctcccttattcagattttcagaggtaaaagcattgtttcttatatatccaggcattttcctatcagaatgtccaacatatgtatatttatatatagtcatgcacctcataattacatttaggtcaatggcaggccacatgtatgatagtggatggtcccataagattataattgaactgaaaatttcctatcatgtagtgacatggtagctttcataacctggtaacacagcgtattgctcacaggattatagtgatgcgatgcagacaaacctactgcactgtcagctatgtaaaagtatggcacatacaattatgtacagtacataatacttaatgataataagtgactatgttactggtttatgtatttactatactatactttttatcattattctagagtgtactccttctacttattaaaaaaaagttaactgtaaaacaaccccatgaagagtaatatattctagatacacttctgtacttgcctttcacacagttgatcatgttgttcaaattgtccagatttgggcattagtagctcctttaagttggctccgatgtcttgtagacttggcccccattattttgtgaacatgtctttactttctggcactttaaatggtctaagctcatcttgcattcctcctgctctagtctggactcagtcatttccccagggagctctggttcctttcatcgagaatggtatttagaaaccaagatctggaaactagttgtgctcattgctactgggatctcactgcatgtatatccatgagttcacactgatattcctgctctgatttcaatctggagtttgtgctacttcacaatttctctattttaactcttttatctgacagaaaactggctctcaatatccacagtgtatttcttaattactcaatcctagtatatacataaagtagtttcagaaatactaacccataccctatgaaaaacaaatttactaaagtacaatattttcatacagttctttctgtttttagccttctagtatatggttaaaataatgttctccaggttatgttagataattcttttattttttatcccatttagtataattatgtcatttatttgtaatacagttgggcttatttgttactgcttatattccattttgggtcttcccttccccaacatcctggttaattttaattatttatttttttgggggggggtgaaacattaccatatttataggaattagagctatgcatataggaatactctgagtgtgtcacatctctctaatcatttctacccatttttattccccaatttttccacgctgatcctacttaacctctgtaggtgacgaatctcatttgtttctagtttaactttccagtatgtttttcctcatatatgtggatatatgtatattttcttatatatacttctttcttacatgaagagtagtatactctagatattcttctgtactttgctttccacataagaatataccttggaaatctctgaatatgaatccatagagctcttcctcatttattttatagctgcatagtgctctcttgtgtgaattgttagagtttatttaaaaaccactgttctatatatgagtatttaatttgtttcttaaatttagcaattatatataatcttacaatgaataaacttgtacatatgtttttcatattgttggatatgtatcttcagggtagattttataagtgagattatagggctccttatgtagttatattaggtattgccaagtttccattgagaagggttgtagcagtttgtattccttaacagcaatgaaaagagtgattattttcctaagatctggctaacaaaatgtgttgtcatattttaatttattacattttattagttaaaattttattttaatttttacccatctgataggtgagaaataatagcttagcatttttttaatctgcatttttctagttatgaatttgcactttacaggtatatatatgtatttttctttttaaaaaattgtattttaagttctggggtacatgtgcaggacatgcaggtttattacgtaggtaaatgtgtgccacggtggtttgctgcacctactaacccatcacctaggtatcaagccctgcatgcattagctatttatcctgatgctctccctcttcccaacccgctgacaggcccgagtgtgtgttatttccctccctgtgtccatgtgttctcaatgttcagctcacacttatgagtgagaaacatgaggtgcttggttttctgttcctgtgttactttgctgaggatgatggcttccagcttcatctgtgtccctgcaaaggacacgatctcattcctttttatggttgcataatattccatggtgtatatgtaccacattttctttatccagtctaccattgatggacatttgggttgattccatgtccttgctcctgtgaatagtgctgcagtaaacatacacatgcatgtatctttataatagaatgatttatattccttttggtatatacacagtaatgggattgctgggtcaaatggtatttctggttctagatccttgaggaatcaccacactgtcttccacaatgcttgtactaatttacattcccaccaacagtgtaaaagcattcctttttctccacagcctcgccagcatctattgtttcttgactttgaaaagtgattatatgtatatttacggatcactttttcaacagccttgttaaggttgtggagacaaaaaccaccccatcttggatgctaatccaccatgttgacttctgattagacccagtcccatgaataacttctggtttctactttatttactgtccctagtataagatcaaaacaaccctgatgttatcacacaaattataggctaggacacacatagcattttcgcctgttctggagggttgcctttaatcgtttttgctggagcatgtgtaccctttccatacggtacccaaaccttgggtctgggaaataacagtgtggagatctacctgtcttgcagtcatccaagatcacacttctgtccataagttcctcagtaaatcacccattactgacgaactggatttgttcacttccttctttggtttctgggcttcttcagcatttgggaatagctttgtgtgcacagccttttcacagaacaaagatatgacctactttctgtttctatagagttgttaaagccatttgtgtgtctctgtgtgtgtgtgtgaattgtctattgatgcccttttcccattttttctaatgggtgcttggtgcttgatctcttaatttctaacaattatttacatattaggaatattagcccttttcctgtaatatatgttgaaagcatgtttttaacctggttgtcagttgtcttttgactttgtttatgatatttatcatgcagtttatttttatgttactagattcatcagtcttttataaatggcttttagatttagatttataaccattgccaactgctggctcctccagaaaccaccaaaatggtttactgatgaacaaaaaccaagtttattgctcactgcagtaaggaagatgactgtcttcacataatcttagtagcctcagaaaagggagtcaagggtgggatattggtaagctttggggagtctggttctaaggtatgtctttcaacatgaggtgtgcagtcctgactgggatagggtaaagtttggattgctggatacagtgaggcaagacctataaagccagccttgaaaggtaaacagtcacttgaaaacccagttgagtgatctactgttctgaaaagaaggctgtttagcccgatgaggctgtatgagtacagatacatagatcggaaagtttccaggacaaaaaagtaatttcaactttactttcttaggcaaggatttcttggaatagtaaagtcatcttagtgcagacagttcctaatctctttattttttatttttagagacatagtctctctccatccattaggttggaattcagtgttgtgatcataactcactgaaatcataagctggaatgcctgggcccaagtgatccttccaccgcagcctcccaagtagctagggctacaagcacatgccaccatgcccagctaatttttaatcttcttatatagagacagattcttgttatgttggcaagactggttttgaactcctggtctcaagtaatcttcctgccttggcctcccaaagtgctaggattacaggtatgagccaccatgcccaaccaaacagttcctaatctttttaagctgtgtggcttcaggttgcttttgttctcaacatatcctctataaatagattcctaccattggctgcgcgtggaggctcacacctgtaatcccagcattttgggaggccaaagcgggtggatcacctgaggtcaggagttcaagaccagcctggtcaacatggtgaaaccccgtctctactaaaaatacaaaaaattagccaggcatggtggcagatgcctgtaatcccagctacttgggaggctgaggcaggagaattgcttgaacccgggaagcagaggttgcagtgagccataagccaagatcccaccattgcactcaagcctgggtgacagagcgagactctgcctcaaaaaaaaaaaaaaaaaaaaaaaaatcctatcatctcttttatcttcaggtcatctttttctattttgatgtgtaaattctagttctatgttcttttagttttctgcaaaagagtacatggggatatatttataaatgcatgcatattcaaaaattttcttctgcccttacatgtaaatgataatgtgaatttcatttaggatttttgaatcatatttttgtacaatattttcataccgttctttatgttgaaggggttcctgtagcagcctgcattttcttctgcagtacttaccacaatcagaagttacgctccatcaaggcagtgagtatcaggtttatacactgctatattcccaatgcctagaaaaatgcctgacatatgataatacctcagtaaacatttgtcaataaataagtgaatgaggggcgggtgcagtggctcacacttgtaattgacactttgggaggccaaggcgggaggatcgcttcaatccaggagttcaaggccagcctggacaacatagtgagatcccatctctacaaaaaataaaataattggccatgtgtggtggtgcatgactgtggtcccagctactcaggaggctgaagtgggaggactgtttgagcccaggaggtggaggctgcagtgagccatgattgcaccactgtactccagcctgggtaacagagcaagtctctgtctcaacaactagaaaagaaaagaaaagaataaatgaatgaattagaggttgtatatgtaatgtatttcttctcctctggactataaacttaacagaaagaggaatcttctacattgtttgcctcttgtgtttcataacaaagtatctgcctcataaagatgttgcatacatttttgtaagccagtgtatgtttgcataagtgaaattcagtaaaatgcattccggtaagactcaagtagaaactaattatatattcttcttccttcctttccttttccttttccttttctttgtcttactctttctgttacccaggctggagtgcggtggcctgatcacagctcactgcagccttgaccccactaggctcaggtaatttttccacctcagctttctgagtagctgggactacaggcacacaccaccatacctggctaatttttatactttttctacaaaaatacaaggttttgccatattgcccagtctggtcttcaactcctgagctcaagtgatccacctgccttggcctccaaaagtgctaggactacagttgtgagccactgtgcccagcctaattacatattcttatttcaagacctctttgaagataaacctttagtgctaaataatcattcagtatcatatcctctcagcttctaggaccaaatatttggcttatctcaacaacatgtattcagaatgcccaattcaatcttgtctttgcagaaaaaatcattttctcttatacacgatcccaaaatatgcaagaaaatatacatatttttctcttctcccccttgtttcataaactggtgttgagtttttaatttttattgatggtttggaatttataatgaaaatgaaaatgctgatgaggtctttggctgtagtaacaagaagtactacagatgactcagagaataaagctgcctcacattacattaaaactcatctcttggaaaatggtgtaaatggttgactggagatgaaggtaatttatcaatttatgtggttgaggcatattacatgatcttaactttcataaaattaaatctgaatatataacaatttgaaataccttaatgctaagccttatcatttggcgaagccccttttatcaaattgaaactctaaaattacctaccatcatttatcccaatggtataacatgtcaatggcttacaatgtatcatttattttcataatccatccttcatgaaaaatattacctaaagtgtttaccataaaagtgagtgacacctaaggcaaagaaaaataacaaaaatagaattaaagagaaaggactcagaggatggaagacattgatttaggaagaatgaatgacggagttataggagcatcctataatgttaagttgttacatcttgctaaaggccaagctcattctgcatatgtgaagagttgattgcattatttacatagatgtatcttgggatttgaacaaagttgtaagtcagtatagaggaagttgggcattccagggtgagcctattagcgtcctccagagtagaaatattggaatggtctcatacagaagagatagaatataggataattcgtcattgattacttcctctgaattaggatatatttataatactgtttttaaaccagataaaactagagaaaatctcaagtaattagtcaatttattgtattccccatctttcttctctgaaacattccctaggtatacagtagtgtaaatatacatttcaaaagagagaggtgctacagaccctctttgcaacctgtatgtgtatccaatcctcttgtcttcttcttcattctgtttcaagaggattacacttttaaaatgtcttttgaattcctgatcgccttaccattccatttccactgccttgtcacctttcacaaagagtactgaggtagcttctttaaaaaatatgtatagtttcaacttttattttagaatcagtgggtacatgtgcaggtttattacatgggtatgtttcatgaagttgagtccgttacccaggtagtgagaaaaatacacaatagttggtttttcaacccttgtccccttcttctctcctccctctagtatttgccaggatctatttttcccatctttatgtccatgtgtacccaatgtttagctcccacttataagtgagaacatgcagtatttgattttccatttctgtgttaattcacttaggataatggcctccagttgcatccatgttgccacaaaggacataatgtcattcttttttatggctacatagtattccatggcgtatatgtaccacattttctttatccaatccaccattgatggacacctaggttgattccacgtttttgctattgtgaatagtgctgtgattagcatacaagtgcatgtctcttttgtgtaaaattatttattgtcctttgggtatatacccagtcatgagattgctgggtcaaatggtagttctattttaaattctttgagaaatctccaaattgctttccacagtggctgaactagtttacattcctacaaacagtatataagtattcccttttctctgcagccttgccaacatctgttattttttgactttgtaataatagccattctgattggtgtgagatggcatcttattgtggttttgatttgcatttctttgatgttgatataatcaccaaaaacgtaaacatttcagttgctattggttacatgttacgttttctgttgtttttattgttgtgtagttcctcctgagctggttcggctctgtgtccccacccaagtctctcaccttgaattgtaataatccccttgtgttcttggaggaaccccgtgggaggtaattgaatcatggggagggggtttcttcccatgctgttctcatgatagtgagtaagtctcatgagatctgatggttttaaaaaggggagttctcctacacatgccctcttgcctgctgccatgtaagatgtggtttttgccttacaccatgactgcgaggcctccccagccatgtggaactgtgaatcaattaaacctcttttctttacacattacccactctcgggtatgtcttcattagcaacatgggaacagattaatacagtaaattggtactgggtagtggagtgctgctgtaaagacatcagaaaatgtggaagctactttggaactgggtaacaggcagaggttggaacagcttcgaggactcagaagaagacagaaaagtatgggaaagtttggaacttgctagaggcttgttgatggctttgaccaaaatgctgaagtgatatggacaataaagtacaggctgaggtggtctcagatggagatgaggggtttgttaggaattgaagcaaaggtgactcttgttatgctttagcaaggagactggtggcattttgcccctgccctagagatttgtggaactttgaacttgagagagatgatttagggcatctggtggaagaaagttctaagcagcaaagcattcaagaggtgacctgggtgctgttaaaagcattcagttttatttattcacaaagatatggcttggaattgtaagttatgtttaaaaggaaagcagggcataaaagtttggaaaatttgcagcttgatgatgtgatagaaaagaaaaactcattttctgaggagaaattcaagccagctgcagaaatgtgcaagtaacaaggagccaaatgttaatacccaagacaatggggaaaagtctctagggcatgtcagagaccttcctggaagcctctcccatcacaggactggagacctaggaggaaaaaatggtttcctgggccaggtccagggctccattgctgtgaggaacctagggacttggtgacctacatcctagctgctccagccatggctaaaaggggccaaggtagagctcgggttgtggtttcagagggtgcagcttggcagcttccacatggtgttgagcctgtgggtgcacagaagtcaagaaccaaggtttggaaacttctgtctcaatttcattggatgtatggaaatgcctgaatgtccaagaagaagtttgctgtaggggcagggccttcatggagaacctctgctatggcagtgcagaaggggaatgtggagttggagcctgcacactgagtccccaatggggtgctgcctagtggagctgtgagaagaggggcactgttctccagaccccagaatggtagatacactaacagcttgtgctgtacacctagaaaagacactcaatgccagcccatgaaagcagccaggagaggggctgtaccctgcaaagccaaaggggtggagctgcccaaggctatgggcgcccagttcttgcatcaggatgtgagacatggagtcaaagaagatcatttcagagtgttaagatttggctgccccgctggattttggacttgcataggccctgtaacctctttgttttggccaatttctcccatgtggaatgggtatatttatgcaatgcctatacccccattatatctaggatgtaactaatttgcttttgattttacagactcataagtggaagggacttgccttgtttcagatgaaattttgggcttggacttttgggttgatgctgaaatgagttcagttttttgaggattgttgaaagcgcatgattgtgtttttgaaatgtgaggacatgagatttgagaggggccaggggtggaatgattgtagggaaaagaaagagagatcagactgttcctgtgtctatgtagaaaaggaagacataagaaactcattttgatctgtaccctgaacaattgttttgccttgagatgctgttaatctgtaactttagccccaagcctgtgctcacagaaacatgtgttgtatggaatcaaggtgtaagggatctagggctgtgcagaatgtgccttgttaacaatatgtttacaggcagtatgctggtaaaagtcattgccattctccattctcgattaaccaggggcacaatgcactgcggaaagcctcaggggcctctgcccaagaaagcctgggtattgtccaaggtttcccccaactgaggcagcctgagatacggcctcgtgggaagggaaagacctgactgtcccccagcctgacacccataaagggtctgtgctgaggaagattagtaaaagaagaaggcctcttgtggttgagataagaggaaggcctctgtctcctgcatgcccctgggaatggaatgtctcagtgtaaaacccaatcatacattcattctattctgagataggagaaaactgccctgtggctggagatgaaatatgctggcggcaatgctgctctgttactctttactacaccgagatgtttgggtggagagaagcataaatctggcctacatgcacatccaggcatagtaccttcccttgaacttatttgtgacacagtttcctttgctcacaggttttcctgctgaccttctccccactatcaccccgttctcctgccacattctccttgctgtgataatgaaaatagtaatcaataaatactaaaggaactcagagaccggtgccgatgcaggtcctctgtatgtggagcgctggtctccttggcccactgttcttttgctatactttgtctctgtgttttatttattttctcagtctccccatcccacctgacgagaaatacccacagctgtggaggggctggcccccttcagatgatatggtttggctctgtatgcccacccaagtctcaccttgaattataataatccccacgtgggatcaattgtgggaccaggtggaggtaattgaatcatgagggtgtcttctttccatgctgttcttatgatagtgaataagtcttacaagttctgatggttttataaaggggagttcccctacacaggacctcttgcctgccaccatgtaagacgtgcctttagccttccaccatgattgtgaggcctccccagccatgtgcaactgtgagtcaattaaacctctttcctttatacattacctagtatcgggtatgtcttcattagcagtgtaagaacagactaatatgctgcttctacagtttattgaatttaacttttaaatcaagttgtgattttattgttgttgttgtctttgagtcttgccatccaaatcaaaactgggctaatttgtggaaataatatctattgggttaaggagagaattgttagatgcagcctaaaagaaagaatttagtgttcactgtatctatcatgaaaggctctttctatttgttttctattataaagtaatatgctgtatttcatggcaaaggctttaaattgaaaactccaaggcttaaaatttaagccttgcatttggaaatagacaactagctctacagaagtagttttgttttgtttttgtttgtgtttttttgcagtggggggctggtatttgggggcagggagaggggaaaaagtccatttgctggtactgagtgactttgggcaagttacttgccctctgtaagcctcaatttcctcatctataaaatgggatattagctttcttgtaggattgttgggagaattaaatgagataaggaatatctgtaaagcagttaacatgaaacaggccctcaataaatggaaactaattttattgtttgtaatagaaaacaacaatgtgtcagcttctagtaataactttaaaatattctatgcatactatatagcaaaggcagttttacttctaatcacagaacatataacactaagtatagttctaatacttaagaagcaaaataacaccagggcagtaacaaatgctggagaggaggtagagaaaaggaaaccctcatatgttgttgatgagaatgtaaattagtacaaccactatggagaagagtttggaggtttctcataaaagtaaaaatagagttaccatatgacctaacaatctactgggtatatactcaaaagaaaggaaatcagtatatagaaaatatatttgcactcccatgtttgttgcagcactattcacaacagccaaaatttggaagcaacctaagtgtccattcacagatgaatggataaagaaaatgtggcacttatctgcaatggattactattcagccataaaaaagaatgagatcttgtcatttgcaataacatggatggaaccggaggtcattatgttaaatgaaataagccaggcacagaaagacaaacatcacatgttctcacttatttttggatctagaaatcaaaacaattgaaaacatgaaaatagagagtagaaggatggctaccagaggctgggtagtgtaataggggtggggtgggtagggaggtgaggatggttaatgggtacaaaaaaaatagttggaaagaatgaatacagccgagtatttgatagcacaacagggtgactatagtcaataataatttaattgtactttctaaaataactaagagtataatgggactctttgtgacacaaagaataaatgcttgaggtgatgaatactccattctccgtaatgtgattattacatattgaatacctgtatcaaaatattacatgtaccccataaatatatacacctataatataccctcaaaaattaattttttttttttgagatggagtcttgctgtcacccaggctggagtgcagtggtgcgatcgcaactcactgtaacctccgcctcccaagttcaagagattctcctgcctcagccttctgagtagctgagattacaggcacgtgccaccacacccagctaatttttgtatttttagtagacatggggtttcattatgttagtcaggctggtcttgaactcctgacctcgtgatccgcccacctcggcctcccaaagtgctgggattacaggcatgagccactgtacccggccaaaaatcttaaaaaataccaggggacatatcagcatagctgagccactctgactttttatcagtttccggaagacacccatctccttcttacctctaggcctgtgtatttccattcccttcagcctggaaagctcttatccaagctatttacatggctggcttcttattctttagttgttagcttaatgtcaactccttacagacaccctacctgattatcttagctcaattaggccgttccttgctctagtcactattatagcatcctatatatttccttcagagaggttgtcacaacctgaattaccttatttttttgttcttgtttacttgcttactatcagtctctcccattaagctccaatgacatggtcaaggaccacatctacttgtggcccattgaagaccccttgcctaacacagtgtctggtacatgttgaattgtcagtaaatatttgttgaaacaattggttaataaatactgttcctgaaagcctctctgccactgtctctgcagtagaactgcccttgctaccctcagactaatgaagaagagaagaccctaagtaccttatttatacctccaacaagctgcaatcaacccaagaagaggaggccagtccgtctcccatggttcccacacccccaacccccactcatcaccagagagaacccctggcttgagcccacagcacagacccttcatcctggggtgattgcactgaggaattgctgacctacatctctctggtgtggagctcccaggatacaagcaaaagacccctgaccacaaccactactaaggtcctttcctctgttgccgccaagttgaggaaggaacgtaaacactgacattgccccagagctgcagtgggcagccaggagtgtcaaaccacaatctacagccatacagctggcactcaagggggcgaggaacccacactttcagagcatcgagagtgaacacagctgtaactatgagaaaacatagaggagccacacaactgagcaagagtctaccagttgaccaataagcctaagtgccacctactggatcacaccccaaagcttcaacaccaagaatacctcactaacatactcacctctgaaactagagacaagaagtcagcttcaaaaaaagaccctgcacaaggcctcagcctagtgaaaacagccagaagtctattgactgtactcaatctatatggcagttaaaggaacacccacacatggagatgagaaagaactaacgcaagaactccaaaaattaaaatggccagagtgtcatatgtgctccaaatgaccatacaaattctctaacaagagtgcttatccaggctgagctggctgaaatgacagaaatagaatttaggatatgtataggaatgaagatcattgagattcaggaggacagcaaaacccaatccaaagaaaccacaaatcacaataaagtgatacaggagctgaaagacaaaatagccagtataataaagaacctaatgggtccgacatagctgaataacacagtacaagaatttcacaatgcaatcacaagtattaacagtagaataaaccaagctgaggaaagaatctcagaactcgaaagctggctttctgaaataagacagtcagacaaaaataaagaaaaaagaataaaaaggaatgaacaaaacctccaagaagtaggggattatgtaaagaagccaaatctacaaatcactggcatccctgaaaggaagggggagaaagcaaacagtttggaaaacatatttcaatatattgtccatgaaaacttccacaaccttgctagagaggacaacagtcaaatacaggaaatacagacaactcctgcaagattctacacaggaagatcatccccaagacacataattgtcagattttccaaggtgaaaatgaaagaaagaatgttaaaggcagccagaaagaaaaggcaggttacctgcaaaggaaatcccatcaggctaacagtggacctctcagctgaaaccctataagccaaaagagattgggggcctatattcaacattcttacagaaaacaatcttcaaccaataattttatatgcagccaaactaagcttcccaagcaaaggaaaaataagattcttttcagataagcaaatgttgaaggaattctttactaccagacctgccttacaagagatctcaaaagaagcactaaatatagaaagaaaagatcactacgagctaatacaaaaacacacttaaacacacagaatagtgtcactgtaaagcaaccacacaaacaaaccaacataataatcagctaacaacacaatgacaggatcaaatccacacctaacaatggtaactttgaatgtaaatgggctaaatgctcaacttaaaaggcacagaatgacaagatggataaaaaagcaagtcccaatggtatgctgtctttaagagacccatctcacacataatgacaccaaaaggctcaaaataaaggcatggaggaaaatctaccaagcaaatggaaaacagaaaaaagctgaggttgcaatcttaatttcagacaaaacaaacttcaaaacaacaaagatcaaaaaagacaaagaagggcattacataatggtaaagggtacgattcaacaacaagatccaactatcctaaatgtatatgcaccgaacacaggggcacccagattcatgaagcaagttcttagagacctacaaacaggcatagactcccacacattaatagtgggagacttcaacactccactgacaatattagacacataattgaggcagaaaattaacaaagatactcaggacctgaactcaacattggaccaaatggatctgatagacctcttcagagctctctactcaaaaacagcagaatatacattcttcccatcgccacatggcatctactcgaaaggcaactacttaattggacgtaaaacaatcctcagcaaatgtaaaataactgaaataatacgaaacacactctctgaccgcagcgcaataaaaatagaagtcaaagaccaagaaaatcttcaaaatcaggcaatgacatgaaaactaaacacgctccagaatggcttttgggtaaataatgaagttaaggcagaaatcaagaagttctttgaatctaatgagaacaaaaatataacataccagaatctctaggacatagctaaggcagtgttaaaagggaaattcatcgcatgaaatgcccacatcaaaaagttagaaagatctcaaattaacaacttaacgtaacagatgaaggaattagagaggcaagaacaaatcaaccacaaagctagcagaaaacaagaaataaccaaaatcagagctgaaatgaaggaatctgagacacgagaaaccattcaaaagatcaacaaatccaggagttggttcttttaaaaaattaataagatagataggctactagctagactaataaagaagaaaagagagaagatccaaataaacacaactggaaatgacgaagggaatgttaccactgaccccacagaaataaaaataaccactagaaaccactatgcactcaaactagaaaacctagaagagatggataaattcctggacacatacaccctcccaagactgaaccaggaagaaactgatcccctgaatagaccaataatgatctccaaaagtaagtcagtaataaatagcctaccaaccaaaataaagctcaggacctcatggattcacagctgaattttactatatgtacaaagaagagctggtaccatttctataaaaactattccaaaaaactggggaggaaggactcctccccagctcattctacgaagccaccatcattctgatacaaaaacttggcagagacacaacaaaaaagaaaacatcaggccaatatccttgatgaacatcaatgcaaaaatcctcagcaaaataatttcaaactgaatccagcagcacatcaaaaagctaatccaccatgatcaaatagacttcattcctgggatgcaaggttggttcaacatacgcaaatcaataaatgtgattcatcacataaacagaactaaagacagaaaccacataattatctcaatagatgccgaaaacgctttagataaaattcaacaccccttcatgttaaaaactctcaataaactaggtattgaaggaacatacctcaaaataataagagccatgtttgacaaacccacagtcaacatcatactgaatgggaaaagctggaagcattccccttgaaaactggcacaagacaaggatgccttctctcaccactcctattcaacatagtattggaagtcctagacagaacagtcaggcaagaaatagaaataaagggcatccaaataggaagaaaggaagtcaaactatctctctttgcagatgacattattctatatctagaaaacctcttttttttttttttttttgagacagagtctcactcttgttgcccatgttggagtgcagtggcatgatctcggctcaccacaacctccgcctcctgggttcaagtgattctcctgcctcagcctcccagagcagctgggattagtgatatacaccaccacacctggctaattttgcatttttcaatagagacagggtttctccatgttggtcaggctagtcttgaattcctgacctcaggtgatccacccacctcaacctcccaaagtgctgggattacaggcatgagccacaacacttggcctatatctaaaaaaccttatagtcttggcccaaaatttccttcagctgataaacaacttcagcaaagtttcaacatacaaaatcaacgtacaaaaaacactagtattcctatacaccaacaacagccaagacaagagttaaatcagaaaggcaatcccattgacagaaagaatcaaatatctaggaatatagctaactagggaggtgaaagacctctacaatgagaattacaaagcactgctcaaaaatatcagagaagacacaaacaaatggaaaaacattccatgctcatggataggaaaaatcagtattattaaaattgccatactgcccaaagaacttacagattcaatgctattcctactaaagtgccaacaacctttttcatggaactagaaaaatctattttaaaatttatatagaaccaaaaagagctcaaatagtcaaggcaatcctaagcaaaaataacaaagctggaggcatcatgttacctgacttcaaactatactacagggctacagtaaccaaaacagcatggtaatggtacaaaaccaggcacatagaccaatagaacagaatagagagcccagaaataaggccacacacctacaataatctgatcttcaacaaagctggcaaaaacaagcaatggggaaaagactccctgttcaataaatggtgctggggtgactaagcagccacatgcaaaagattgaagctggaccccttctttataccatttacaaaaataaactcaagatggactaaagacttaaatgtaaaacccaaaactataaaaactctggaagacaacctaggcaataccatcttggacacagaaacagacaaagatttcatgacaaagacaccaaaagcaattgcaagaaaagcaaaaattgacaagagggatctaattactcttaagagcttctgcatagcaaaagaaattatcaacagagtaaagagacaacctacagaatgggagacaattttcaaactgtgcatctgacaaaggtctaatatccagcatctataagaaacttaaacaatattacaagagaaaaacaaccccatagaaagtgggcaaaggaccccttagaaagtgggcaaagaacataaacagacacttttcaaaagaaggcatacatgtggccaagaagcacatgaacaaaagctcaatattactgatcattagagaaatgcaaatcaaaaccactatgaagataccgtctcacaccagtcagaatggctattactaaacagtcaaaaaaaaaaaaaaaaaaaaagaaaaccagatgctggtggtgaggttacagagaaatgagaacatttatatgctgttggtaggagtgcaaattagttcaaccattgtggaaagcagtgtggtgattcctcaaagagctaaaagcagaactaccatttgacccagcaatcccattactgggtatataccctgaagaatataaatcattctaccataaagacacgtgcatgcaaatgttcatcttggcttggtttctcattcttttgttcacttttcggagtcattttcctaccattcatttgtgcatgcagtgtctgaatttcagataacaaactcctatgtgctttctggaggcattccatagctgcttgatattcaacagcactattcacagtagcaaagacatagaatcaacctaaatgcccatcaacaacaaattggataaagaaaattgggtacatttataccatggaataccgtgcagccacaaaaaagaatgagttcatgtatttcgtgggaacacggatggtgctggaggctattatcgttagcaaactaacacagaaacagaaaaccaaataccacatgttctcacttataagtggaagctaaatgatgagaacttacaaatgtgaagaaggagacaacagacactggggtctacttgagggtggagggtgggaggagggagaggagaagaaaagatagctattgggtactgggcttaatacctgggtgatgaagtaatctgtacaacaaacccccatgacatgagtttacctatgtaacaaaccttcacatgtacccccaaacctaaaataacagttttttaaaaataatcaatattgtcccagtcctccattttacagatatggaagttgtgattaaaatgtgattaatgtcacagaaatactaggaaagccaagcttctaacagtcattccagggtcattgccagggtgtcaaatcctatgtcactgcacagtattactataacaacaaagtgtccctttcctgacttcctattccccattcttgatccagcatctttgggatccacttccaggcattttctctggggtcctgctggcttaagtcagccagatcctgcagtgcctttgccatatgatcctcccctcccttaacagacactgtacttacccagttggattatactgaaacttagtcctcatactgtctggtatcggggagagaagtgggggtagattctgagcaggaccaacattgttttgtaagacacttgacttactcgaagcttatagttttcaagcaaggagaaggtcttccatcttccagcaagggagtgggccacctctgtaggcccagatattccggagaagctgggaggccaaggtccttaagtgtgtctaataagtttccccattccaattctcatgttcccacttttttccaatcaggaccctgattctcttgaaggagacttacacaggctgagaattaaccttctctggcgttctgccactcataagtacaggctgcacctgggcttcagttcagttggccttctggctgccagtgatgagggactttttaaaggcttccatggaggccctttgactctcacacttgggtttaaattggtggttaatagatttgatcctggcatctatacttagtgcatcaatggtgcttaccaataccctcccaattcaacaatctttcaagttacttttccacctgtactctcaaatactagatacatcacagaagttaatgcattcgcttctacttatatgctgtcctggttcactacaagtaaaagtgttagcaatttcactgcaggagcacatctgagactatcttcagggaagagattctgatgggaccactggtgagtgagcaaactccagaatcccatccttagactcaggtgtatataactactactgctatcaactgtcttagattgggctcttgcagctgaccctgagaattagattcctgtccaagtgattgcctgagggagtgctctcagaagaaatctgaacagcgaggaaggaagcagaataggacaggaaaagaagctgggaaagatatgggtttagctgaagtctagcctcagtctgatcccacagggagttctggagcctcagttctgtacacccgtatcaatcagtcattggctgtgagctacccacgggggaaggctgttaccttccaggcattttctgaaattgttggcttgaatggaatcctcagggaaagagtgtgaactattagcagccaacactctcagcagctaagggatgagtacgccagctcattgaagagattctggacaggacaccaacagcatcttcagtaaagatgtacttcaatggtaaggacactgaacccagaaagaaggagtcacatgcaagaagaaatggtggaccaagaaatgtataaacatctggctatatctgaataagcactcttatacacaacaataatggggaacaatggctaatttggagatggagggtatttaaaaggcagaatttaaacaataaacattaataaggaatatggggtaattagtattgaaagtttctaaagcccttgtatttctgaggtgaagggtaaatacattaattaaatttagattttattatgtcaagttatacttgtaaaaatttaatggagctcccagatgtagggagtaaattaaacacatgcatcaaatttggtcctccccaaatccagttaatttgtcagtgaatttttttaagtcctgggccatgggaaaataaacaataataacacaattttggaaaattggatgagtgagaaaagacttagcagaactcccaaattaaagtactaaaccagcagcaggaaagccaagaagcaacttgttttacactcaagagccttcaagtgtcaggaattggcagcatcagattcttctggaagtgtggtgaagaggagagactaaaatgagaatgatgcgctgaaagtttatttaagaagcagtcagatcactagatcctttccaatcatgaaaaggtacactaccgcttctatttcccttctctttcccaggaagcatattcacaggagagagagaacaggtttcctgcttggggatcccaagcagagttgaagttgggagcactgtactgaacaaagccagcttaagaaaatgcatgcatactgaatgcccacctctctctactccactatctcgcttgacccagatccaaaatagtagtagcagactttgactcttctgacaggagattggaagaatcttacctgatcagtccaggaggaaaacctaaatgcagtaacatcagggttccctaactaagctgtccagaacttaccatcttcaccaaaacaagaaattaaaccaataaagtggaagatcagggcaacacacccaggacatacacccaggttgggagacacatgtaggagagtaagacagtgaggccagaatgatgctgagggaaagtcccaagatgacagctttatgtcttacgcatcaggcataaagaccaataggccatcagaagaatgaagcatattttgtcaggaagatgaaagcaatgcatcttagtagcttaagagaagatttagagaactggcaaataatttgggattaaattagtgataagtacatagaaaactaagcaaatggtaaaacaagataattagctccagggcaagcaaaaagctgctcaggaaagaaaaatttatcatagtttcctacatggctcagctgtgaacagtttgtgcatagttatattaatgtaaatatattgcttgatatcaaacgcaaacataatatgactgtattgtgagggcgtgaagaggaaagaaggcacatatatggtgggagcagtcattttctagagtgggaagtcagtagataataccaaaaactggaaaattgagaaatataagaaattgagaaatgaatgttttttagagacatggaagtagataccaacatgaccagtaaaagaaatgtaaatgattgtttcaggggaaggaaggagggatataaggctcatgaggaagtatctgatattttcaactatgagtttttaaaatttttggtgaaataaaatctaaatataaaaacaaagatggaatgggaatataatgaaatattcaactaaaaatatttcaatggcaactactgaaagaatgcaaagaaaatatataatttccaaaccagtatgaggagaaaaaagaaaaagagaaaaaaataaaacacttcagtaatcccttagaaaacaggaaagaagaatggaagaagcaaagcagaagcttggtaataaagaaaagaaaaaaaaagtaaaagaggctgagcacagtggctcatgcctgtaatccaacactttgggaggctgaggtgggcagatcacttgagcctaggagttcaagaccagcctggacaagatggtgaaaccccgtctctacaacaaatacaaaaattagccaggtgtggcagctcgcgtctgtagtcccagctacttgggaggctggggtgggaggattgcttgagcctaggaagtaaaggctgcagtgagctgagattgtgccactgcacttcagcctgggcaacagagcaagaccctgtctcaaagaaaggaaggatggaaggaaggaaggaagggaggaagggagggaggaaggaagaaaaaggaagggaagagggacggaaggacagaagagagagagagagagagagagtgagattcaactaaggtaaccaggcaagctttggaagagaagtgtaagaagaagaaagggattttaaagaatgtgtggataagtgtgacagtcttcagccaaacaaactgattcccagcagtcaaagacaagtactcaagcactgcagggccatgaggaccttgagaaaaaggaaaggtggtaaggaaatcactcagagtgggccctgggtgctggccaataggtggtgctgtctgtatggacagcagtgttgtcatccagggcagcaacacagtggaaaggaaatccaaagcttaatgagccattcacatataagaacctttgccagctaagtgttcataatttgagaattacatatatttcagtattcattatatgactcaagatttcaatatttcaatattcaatctacacaactgatatggtttggctctgtgtccccacccaaatctcatttcaaattgtaatccccacatgttagaggaaaggcatggggggaggtgactggatcatggcggtggatttctctcttgctgttctcatgatagtgagtaagttctcaaaagatctgatagttttaaggtgtggcaattccccccttgctcttttactctctcttgccaccatgtaagatgtgtcttgcttctccttcaccttctgccatgattgtaagtttccccagccctgcagaactgtgagtcaattaaacctctttttctttataaattacccattctcaagtagttctttatagcactgtgaagatacaataaccaacacttatacaatacaataaccaacacttaactagtattaatgatatacccctattaagcaaaaggatttcttgagtgaagtaaacccaataaccagtatttcttttcaaaaacatctataaaaatactaggtttctataaaattttccagataccacttgatagtcattcaattgaacattgaatatgctttgtctcaatttccaacattcaagataaatattttttctattttattacctttttcattttatcattaaaattattatatcatattttttcatttttaaagagagagtatttcagtaactttataaattaagtaagtttttgctggccaatttggaaaactaaacaactattttaaaagaggaaaacgcacaccggaatcaacaagtaaaaattgaatgtcatttttattactatttttacttataagaattatagaaatatttggttatttcaattccctatgtgtataactcatcacaatttgataaggagataggtttaagtgtatgtgtatataaaaagagactgaaaggaaaaagataagtagttatctctgattggttgttgggattagctatattttccaaatactctagaatgaatatgtattacttttctattattaattgggttagggattaaaaaaacattagacctgtatgttaaagttgaaccagcatcgtcaggaaggatacaaaaatcacctgccaaacgatgtccatttcaatttactttatgtcctttctaggaccactgtgagcagttgtaggtacctgtgagagtgctcaatgtaaaaaaaaatttctgttaccctaaattgggttaatgataagtgtctaaaggagatgtagatctagcatataagaccttctagataaatttaaagatatcaggaatgaaggctgcagaggagtactttggaaaaaaagtttagtaatgaaaagcaatatgaattgtttcagaaatactgtgacttggagacatgggaagtgtatcaaacagaagtcgaggacagacataaatgaagtgacttgctttcaatacgacagatgtccaagacggaaaaatgtcacccagggcaagaaaatgactcaggctggaataaagaaactagctgcagagagaataatttaatcaggaaatcgaagccaggtacagtcgctcacgcctgtaatcccagtgactccagagcctgaggcaggaggattgcttgaacccaggagtttgaggctgcagtgagctatgattgcaccactgcactccagcctgggcaacagagtaagacctcatctctaccaaaaacaaacaaacaaacaaacaaacaaaacccatagggaaccaagtggaagacttaggatctattgtcttcttttatctcaagctggtggaaatagctctgcatttaaaggtagaaataaggatggagcagatagacaacccaaaactaagagtcataactataaaatacctaaatacatattaattttcaccaagctaaagtgaaaaatgaaatgttcaatactatctatgctgtatttgtacgtatgggatatggtgtgtggtggatactgggctgggcccttgaaactatgaggctaataacactgagaagggaagatgggagaaaaagcagtatgggaggtcttaaagtcttggtaacttcagaaatgtgctaggatttgtgggcagcagatatttcaaaacactaagtaaagaacgctggagttaaaggcatggagcttcagaaagttattagcactgatagccaaccacggtggtgggtgcctgtagtctcagttacttgggaggctggggtgggaggattgcttgagcccaggagttcaaggctgcagtgagctatgatcatatcactgcactccagcctgggtgacggagaccccatctttaaaacaaaacaaaacaaaacaaagataagaagaaaagaaagttactggcactgagagccagacagatgcccaaagtaagagcccattaagaatttccaccatgagataactggaacagtaattttcacattaaaaatagctttcttcctgcacttaaagggatggttcgaggaagcagattctaaaggagaggtgaaaaagaagacatgctctggatgtttggagatacagctataagccaacatcctcggcaagccctgtaccaccccaatgccaccactccctgttccagtgggtagacatgggtgggagcagcatgagtgattacagttagggggctaatatcaccgtctttatttcatcatgtctccaacattctgagaaggacatagtggtcactatccctcaaccaaagaaactgatgagtgcagtaggaacctgctttggagggttcacattgggactcatcaatgtggaaggtaaaaatctgaagatacaattgaaatctagatagccttgaatggtatggacaaggagacataaaatctgcttactaaatcagaataataagatgaaaggtcaataataagcatagaaaggtcaataatggaataataatagtagaggtcatccctagaaggttgaaaacattttcaagtaaatataagaaactccttattgtacgtagtagtgcaggctggaaaaatatacttatttagttcaaatcatgtgacaggcactaggaataaagttagtccctgccctcacagggttcaaggtctaaatggaataatagatatgaaataactcaacaagtaaatagctcagctgttggaaatcaaacaaggagaagaaaagaaaaaggacatagtgctataaaagaaaatctttataaaattcaaaaccatttaaaatatgttgccattgatttccttattaacaggttttaatacctccatctttctctaatagttttcagtttattagaaacagtatgtgaactttttagattaaaaatttccagcataggtttatcacttattatatccttttattccttgaaatggatgattgtcaggcagaaatttaggacaaaggagctggaaaatattcatgagactcaggaacaaagctattactccaactgtaaggtttcattataagcacgtaaatatagttcaaagttaccacatctgtaaactcaaaaatgctgctcacttggctggatccaatcaatatttgctaaccattattttagttattcttcatatagacaggcgctttgtttcttagaagaaatcactgtccataaccaaaaaaaaacttaattgtgaaatggttttatttaaaacagtcttttctggttattgaacatttcatatgaataaattaatcttcatgcatatgatagcttatctgaaatagcttcccaattctttaaaataccaaaggcttcttttctcagaataaggcattttgccatcacgtggtttattagcagaataggaaaattaatcttattctaagcaaaagcagaaatataattagccaaaccaagaaaagtgtgacatttgcccatgaactcttcattcagataatatatctattttgggaactcatgagacagaagcaagacaaaaatatgagaagatattaggtttctctaactattgttcaaaattagaaaatggatgtggcttttatgttgactctttcaatacctatatgaagacagttaaaggatgtatgaaattaaaaagcgacatcagtgattattagtaactacttcacaggaagcaaatgggagtatcattgtagttagtggtatgtgaacgactgattgtactggtttatcttcatgctctcgcctcttctctttaactctacgcagtacatagtatgggattatctttaccacatgcccctagagattctgtttcacttcactcagaacctagaaaccacttgctccaaaacttgaaaaatattaagagctgatgtccccagactgctcctcaaccttgaactcaaaccactaagctccaggataaattcgtttaaaatgattgtgcttaaattttcatgtgggtctaaatttgctgggagagaaagtcctttgtttgtattttcgcatattgagaatatttatcatgattattacactgaagagcctaactattcatttaccccatttttaagatgtagtaaagacattttcctctgtggaggaagctattgtgcaagattttatcacgtgttggcggaaaatttgagtgtctgaattttgtttcacacatgtgttcagctttgcatgtgtatttctgtgtgtatatagaacatagaaaagagtctagattagaagataatgtactgaccacgttcaaagtgattatttcatcacgcaggtaataagcatagtactccataggaagttttttgattctctccctcctcccagcctccaccctcaagtaggccatggtgtctctttttccgctttttgtgttcatgtgttctcatggtgtatctcccacttataagtgagagcatgcagtatctggttttctgtttcttcattagtttgcttaggataatggcctctagctccatccatattgctgcaaaggacatgatctttttcttttttatggctgcttagtattctgtggtgaatatgtaccatattttctttattcagtctactactgatgggcatataggttgattccatgtctttgctattgtgaatagtgctgcaatgaacatacatgtgcatgtgtttttatggcaggatgatttacattccactgggtatatgcccaataatgggattgctgggttgaacggtaattctattttaagtttttcaaggaattgctacactacttttcacaatggctgaactaatttacattcccaccagcagtgtataagtgttacaaaagattatttatgaagacagagattatatgggagtattcttttctttagtatgttcctctttattttctagattttttgcagtgagcataccttacttcatgatgaggaaaaaaaattgttattcctccaaaatgattgagcactttgtatgtacacaatactgcaataagtgattacgggaattaaaaaaaaccttttttcttttttggagctttcaatattcacaaataagttgacgctatgtgataatatttgtattgcctgttatgtatcagatacttctcccatttaatttcacatactctatctcctttaatccaaatatagagaatacgtgtcaatccactccatgttattgtaaataatgttgacaatgcacagagacgcatattttataatagtaagttacaaacacaaggtaaaaataggcagacagaaagctatgcataaagactaaatggaaagcagtctagatagtgataatttttttctacctactaaatttactagtaggagcatgtatccttcccataatgagagaaaaaatgaacttttaatgatttttaacatatatgacagccatggaacaattctgtgctaactttggggtacttatgtgcagcatattggacatttagtgaaaagagagaccactgtgagatgatgaagctggagaaggcttcaagaagcaatgcagggctccctgagtactttaaaggaagggcaagtttctttaagaatgtggaaggaggacaaggaggacgttatagaaagaaaataacttgtacaatagcaacaagaactggtccatttataaaacaggagcttgctcaggtggtggctatgaggattaagtaagttggtgcacctggcatcatgcctggatgaaaggtgctcaggaaatattagccatcatgatgatggtgctggtgagaatggagaagagggatgaattcaagacacagtccaaaggactaaatggtaaacttgttcacagtctggttccttgaatagaaataaaagtgccaactaggccttcattgtttctctcccaagacagcagaaggagagtgcccgtgtcagaaggggaacaggctggggagctgggcagcaggggtaggtgatgagacaagtttgggacactcagagttaaaagtttgggaggtaaaggaagtgtggccagtgaggcggagaacacagaggtggcatcagagaaacaagagagggaagatttttcagggatgtcatcaactcttcagccagcggaatgcaggcggagttgaagaagtggaaagagaagtcccccagtgctatactaattgtgtcaccaattgaagcaccctgctttccctattcttgcatctaattgcagtacgctaccatgaaaccagttcattctgtgctcaatttgctgttctgcttaaagggacttaaacttgatatctgaaggccaactgctacgggccattacatttatttccttccaggcattgtatgtagataagcaattaaatgagggaaaagaagttgagagtcatttatcatggagaaaaaaaaaaaaaaaaccattgaacaaggctgtacaagcaaacctatttggattgaagaaaacataacgtttaattctcagaaacaaatgcaagcatcggtccaagtcttccttcccaaacctttgtcatttagggattgagaagctgagttgggtgaaaggttgaatagaaaacaaaaaggaaagctagaaacacgctgagctcatggagatgcagcttcttctgtagctcctaaagcccagctgaggtatcatctaatgagaattctctctatgccaggcactgcgctaagcatttcacatcattaagcaatgtgagttttaggcaaccccgaagcaggcagtctgttcatcccaattgcagctgaggaaacagggtgagtgaggccaagcagctggcccaaggtcccctgcctggtaagtggcacagcctgcagccctgccaggtggtcccgctaaccaagccggcgcttttctgtcaccatgccgtatcgcctcctgtactatcaaaatgtactatcaaatttacctcaaaagaaaaccctctgtcttctgagaagctccggaaggtccaacacgttgcctgccaacaaaaaaacatgaagagttaaaaattagctatcgtacgtaaattattagccatttacattgtatgtaaattatgtttcattaaactttaaaaattagaaaaagattttcttctggtagatttccttaaaaaagtgttacctttaagttttacacttaagtgacccatgttatctgttttaatgaataattttcctaatagaaaattattatgtggaagacgacgacggtagcgggtggcaatttaggataaaaagtgatcaagtgaactcaggacagcgaactctttctaactgtgcacaaatataactgtctattctcttcctggtggcatcaactcaaaatttcagttcattcatttattcagcaagtatttataaaccaaatgaaccatatgaaatcgccattcttgtaggttaaaaatggtcatatgtgggtaattccaaatagttcaacctaatatgaagaaccctctgtgtggtagaatagataatatcatgggagctgggaatatagtgttgcataaatggaccaaggtcctgcctttatcttgctacattctggtggtctaagacataaacaagcaaaaagatacattaacaaaattatcccaaattgtgataagaaataaacaggataaaataattaataacttacttgaggtgaattgaaagctacactgaataaagagatcagaaaaagtaaggtggatggaacatcagaggaagatcattccagacaaggggagaggcaggttgaacgtccatgaagcagattgaaactccttagcagggccctgctgagtgaggggacttgttattaggggagttcagagaagtaaatggaagtgagttttgtagggcttcaaggaccctgacaaagagtttgaattttattctaagttagaagaaagtcactgaaggctttttgcctaaagagttgacatgattcagttaatgtattaaaatataacttatggtgacgggtacagtggctcaaacctgtaatccctgctagttgggagggtgaggcaggaggtttgatcccaggagttcaagggcaacagaaggagaccttgtatcttttatatctatatctatatccatctatatcttatgggtaaaggaaatattctatatttttatcatagtggttacatgactgaatttatttgtcaaaagtcactggaatgtatacctaaatatgtgaattgctgcattttactctatgcaaattgtacctcaaaaaacctaaccaaaaacaaacaaatgaaaagataactctgagctgaagccattaaaaattatttatctggaaggtattggtatgtcttgtttgtttgtttccttttggtggtatcatttgttgaactctgcctgcttaaactctgcacatgtattttttttgtaaaattaaaattatattttatgaaagataactctggctactgagtggagaggaatttataagacagcaagactagagactgggagaccatttaggagactatggcaagaaatgagactatggcaagaaatagtcgtggtggtgatagtggaactgagaaatgggaataacattaaaaacataatttggaagtagaactgacaacacttactgatgggttggatgtgggcagagggggtaaagaaaaagaaatcaaggatgacttttggggtgggggtgtccacatggacaaggcatggttgaaaagagggaacaaacagttcaatgaagggtttgttttggactttaaaatatttgaggtggctatttattattcatccaagtggaggagtcaagaaggaagttggacacataggcctgcagttgaaggaagagatgaggactaaatctgtatgtcatcagtatacatacgatgtcttagtcactttgtgctgcacaatattacagactgggtaatttataaattatagacatttatttctctcagttctaagggctgggaagtccaagatcaaggcaccagcaagtttggtgtctgatgaggacctggcatcttctcactgtagcatccttacatgggagaaaggagaagaacaaaaagagcttagctagttccctccatcccttttataaggttctaattcatttatacaggcagctccctcacgacctaatcacctcctaaaggccttgcctcttgacaatgctgcattggggattgagtctcaatatgaattttgaaggggacatatacattcaaaccatttcacatggtatttaaagccttgggctggattgagatagaagaccaagggtaaagaagagggccctatagcactacaaatttggaagactagtagggaaggaggatcagccaagcagggagacccacattgtctgttccaagaggtatatacatttaaccctttgagtgttgaatctgtgaattagtcagtttggctgccataacaaaacaccatagactgggtggcttaaacaatagatattaattttttcacagctctgaagagggaagaggaagatcagggtgccagcgtggttggcttctagtgagtgcactctgtgccttgcagacagctgccttctcactgcacgctcatgtggcctttcctcggtgtttgccatagagagagctctctctctctctccgtctttttatgaggctacagtcctatagaattagggtgccacccttatgactcctgtagccttagttatctgccaagaaccctatcttcagatacaatcacactgaggattagggcttcaacgtatgagtttgccaggggaggacacaattcagttcatagtaacctgcaaggagacatatcaggggcacattcttgtcacacggccaaacttccattgcaaaatgactacattacaatggatctttatatgagtgtctagcacattgttgcaattattcgatgaactatcattttgaatttgttcagctgcacttgtggaagaggaggggtaggagatgaaaaagaagaagaagagcatcgattgtgtactcactctgtatcaagcactgttctaagtacttttgcatgcatcactacttcgtccagtttttatgataaccctttgaggtagatattttgttttacagatgaggaaacagaggccccaagaagttaaataacttgcttaagatcacagagctaatgagtggcagaacaattattctagctctgattttaagggatttacttaacttttacttggaattcatggagtcattgggctttatttaataagtatctcatcatattctagttatatcatctcctataagtgttcaaaatttgacaaaattcagatcaaaggtgttttgggggcattttggtgtcagaagccatgaggccattaaaactcatgagggctgctttagtttcctagggctgccataataaaggagcacaaactagaaagctgtacatctgaaatcaaggtgtaagcagagccgtgtttcctctgaaacctgtaggggaatccttcctctcttcttagcttctggtggttttatagcaagctttgacacgtagtgaaatctgacacaaattaagtacataagaagctgttccttggttttcagctgcataactccagtctctgtcttcatcattgcatggtcttctccttgtgtgtttctgtcttcacatggccatcttctaataaggccaccagtcatattggatcagaggcctaccctactccagtatgacctcatttttatttaactaattatatctgcaatgatcctatttccaaataaggtcacattctgagatactgggggttaggaagatatgttgaagagcatgtcttttttttcggtgggggttggggaggatacaattcaacccagaattccagacaggggctttgtggatagagtttataatcttaaggaagcacatcccttatttcatctccccttttcccaatcctaacatccacagaaaatttcctgccagcagttccttccttgggtttaaggattccccaatgccagatgttaagtctgctaggaaatctgtagaccacagggaagaaaatgcaaaaagaaaataaagtcctcaaatgcagctaaaaattgctagcttctatttttaaaataaagcaacataatactttttcttccaatttatctaccttcaaaagtcccaacaaatgttgttcgtagtactgaaatctatcatttccctttattttttccattcttcaaattgagctattaagtcaaatgctaattacatgaaacattgttctctgttaataaacgttttgagaagttctgccgcctcaaataaacaactaaaacattaagtcagtgtggcatttcagttgaatagggaaaaactagattacttaataaatggtacagcaatatttggctaaccatttgggaaaaaataaaattagatgcctacttcacaaattaaatttcagatttgttaaagatttatatataattaaattaaagacagatccttaaaattcaataaaattttaaaaattgcaaaataaaatatgtggctatttagtgtatttgggtattgggaagtcttttgactagttataaacactaagatataatctacaaagagataaatcaacttacaaaaaacttaaaacttcatggatatatagaaagcagcactataacatggaaaaaggaaagatgcatacagtatatgacaaataatatgtttatattatgcatataaaaacacttacaaataatttgcaaattaatgttccaacagaaaaatgagaaataattttaaaaggcaattcacaaaagaagaaatacaaataaccattaaacatatgaaaagatgtttctttttacttaaaaaacaaataggatctttcaggcctctttcagttctaacacactgtgattctgaatacaaaggtttcagttggaacatttttgcatagatttgcccttgaactgatcctccagtgcaaaatactttaattgctaacgtaaagtttcataaaagcacataaatctcatttattatagttctaatatgaaaatctggatctctttagaaccagctttattaggatctcttggctgcatatgtcagaatctcaactcaaactctcttatgaaaaaaattcagcagatgtctaccacctccacacattcctacatccttaatctccctgtgttttaaaactctaaatgagttctcttagaaatataaaggcaaagacacctcattcttctctcttgctgagtggagaagaattaaattctcatacttataagtcgaacagctttaagtagaatagacatggagggccagctaacctctccagcgacttcctagtaatttaacttttcagttccagaagtttctagaagaaaaccccattcctggcttaactcagcctataacctgagcctctagttgcagctcactgaagcaccataagaatagcaaccatgtgtttagaacagcaaccatacgacagcaaccatgtgtcatggcttattctcatcaagcctccaggttgtagggagcttcggtgattatatttttgtttaacagccctctcacccaccctcctcttgggttccttgggtaatcactccctctctttccatgtggtccaggcaaacctgtcaatcacaacatcttcaccaccttccccttgccaaaggcttacaacccaagccagacaatcagaatgttcctagggttggattaattgttgttaggagaaaggcacttttagccatggagcaggcaaactcaggatgagaagctgggctactggtggccaaagaaagtgatttctcacaggagaagttgaggaaagaaacagggaggcagggccagagatgatgagggagacagagaactccgtaaacaggagtaccgaagtttgttgtagccccggacttcccagatgtgtaagacaataaattctctttttgcttactagcttgaattgggtttctgtcatttaaaacctaatggctccaacttgtgggcacttctgacttacagggcagctcccacagacctcagtagctttaccagtcttccttgtcttgtgagctaccatcttctactcttttgggagtgtgcgtgcatgcttcggattatcaaatgatttcaatgacaacaaagaactgattgtagttttgttcttccaaaaattcatctttcacttccaaagaagtgagatgtattttacacacacacacacacacgcacacacgcacacacacactgcatttctgttgggtccactgattcatgaatttaccctgacactaaacattcctttccattctagttttcaatacagagccagtttcagcaagcttagaatagcaggttctttgctgaaaaaaatattttgtttcaggcaagttctgtcagttgatgattgctatattacaaattacccccaagcttaccaattttttttttttttgagacggagtctcgctctgtcgcccaggctggagcacagtggtgtgatctcggctcactgcaagctccgcctcccaggttcacaccattctcctgcctcagcctcccgagtagctgggactacaggtgcccgccaccacgcccagctaattttttgtatttttagtagagatggggtttcaccatgttatccaggatggtctcgatctcctgacctcgtgatccacccgccttggcctcccaaagtgctgggattacaggcgtgagccaccgcgcccagccaagcttaccaatttttttaaaaaacaaatgtcatctcacagtttctgtgagtcaggagtccaggagcttcttagctgggtggttctgcctcagaatctcttacaagacttcagtcaaggtgtttgccagggctgtagtcatctgcagcctcaactggggaaggatttgcttctgcactcactgccacggctgccagcagtcctcagttcctcactacgtgggcctctccacaggctgcctcacggcatggcagctggcttctccgagtgaggagtttaagagtgaaaaagtgagcacgcacctcccaagacagaagccacagtctttcaataacctaatctcaaaagtgacatttcatcctttctgccagatctatctgagtccttatgtccagcccacactaagaaaaggggaatgtagctccatctctttgggagagaagcatcaaataacttgtgaatatatctttaaaaatcaccttacaagtggtggcgctcgcttccccaaagagaatctgagttctttctaaaataccaatcctttgttaaaatgagatggagagtagatgagggaatgcagcggcaatagggaagacaactattccaggcagaagagaaatgctgtatcatccacacacattcctcaacatacctaaagctacctttaatggttttaagtaagaaaatggctgagggatttaaaaatctttactgggaattagaaagcccctagcaatacaactcagtaaactggcattaagatacagccatgcgattatcgtggatgggaaaacggcaagattgtaacaatctgcaagcatgttgattgatcagagttgcaaagtactatcagctggccgatggcatacacaaagtgcagaggagctctcaactctgtaagaagaacaatgccggaggagtagaatagctatccttagcccaggtgctcactgcccctgtcacgtatgctcatgccacacctgagataccgggagggcagcgtcttgtcctatgtcctcccattactttcattcccaaagtatttctgcctatagagctcttccggcctctaaactccttccagctgtgtccaaccttttcaatgcaaggactattttgcttatctgtggtggtggatatcatgaaaactatgcatggacctttttttttttttttttttttttttaggtcatcagctattgttagtgttagtgtattttatgtgtggcccaagacaattcttcttccaatgtggcccagtgcagccaaaaggttggacacgcctgcaatacttagtaatgtatatcattcatgtggtgataaatatattcagacgaagaataattctttttttaaaatgtaaaatcacaattatttgatgtttttcatttgtgaatgccttttacacgtagtccctacatttaggtgctttggatgcatgacttttcactagaccagtggttctcaaccttggctgcacattagaatcacctggaagtttctttccattccaagattcaacacagaaattaatagaatactgaatcaatttcaatgaactaagagtgacaatttttactaaaaaatatttacttagcaagaagccaagattgactgttgttttagagtctttctactcgaagtgtggcctatggaccaacagcattcttatcagatgataagtgagctgggagcttgtgagaaatgcagaatcccaggccccacatccaaattataatttgcattttaacaagattcctgggtgattcatacgcccattaaaatttgagaagcactcatttagactttcccattacccttctctttatcactctgaatattctccaacttcctatctagtgaccacagagggtactgacagattacagcttcaaagcataaccaggatcaatagaatacattcattctttcattccagaaaaatctatttagatgtagggccagtgcctatgcttgtgcagactgtgcaccacatctgggaagtactattcacaatgtagaaattttacatttggattttattgctacaccattttctagcagacggcagtacagtgtcttgcaacaaaatcaatacacataagctttggctgaatggaagttaagtgcttgaggaaggaatgtcttttttctattcaatggcctataggctagatgtcaccttaatgggagccaggacctggcgacacagcagcaaaccagagaggccaaattattaactatttcccatttaatacaatttgtttattagtttttatgcaaaattatggtatggtagtttttaaaaattcaacgtatgtggcatattttccttccattgcatacgatatagcctacaattttaatgtttaatatacaaaacacagcttgtgtttttttcccttcacaaagtttataacaaatcttggagcacaatctgtaattacaatacatcgtatgcagaaattccagccactttcgagctttatactttatggtgtagtttccaagtacacgttatagcagaagtgaaagaaaaactctatttttctgaatattctataattcctgtcatcaagtgccttggatgtggacattagagatcagtcaatatttgttttaaaacagtattttcaacttcttttatatacttttctgtctctctctctctctctttctttttttccctaatggaatgctctgtcctgcttgccagttttggtgcagagaagccaacaaagatttataaatagggatgctcatgacatcatgatttatgacaggtaaaaacaggaagcattttagatttcaaacaaaaggtagttgatcaaatatatcactacacatccaagtaactaaatagcacatttattaaaaacgatgagtctaaagaataattaatatcatagggaaaacatttatgtaaaatgttaagcaaaaagttttaagaggttaaaaggaaaaaaaaaatcagggtgcaaaaccacatacatagtgtaatctgaatgtccctggctccttgctacttagctagtctacggactagcatcatagcatcaccaggagcttgttggaaatgcaagattttaggctccaccctaaaacccactgaatcggaatcttcaggtgattcttaggcactcgaaagtctgagaagtatcacccaggccgtatcaacttcggggaacagtggtcagtttacttctacaatttgaaccaaagttcattagctcattagcaccgacctacctaatgcaggaccacagtccccctccaagacacatccagtgtcttaggcaggtatctataagtataaactcaggcactggggtggtggccttacctgtctctcaaaatccccaagggggaaatgctgtttgatacaaatgattatttgaaaattatgtcaaagaaagggggatctatttcttttgccctggcaatccctcattaaatatgccttttatgtcatctctgcccattcgttttcctttcggcttcctcctatccctcacacatgcctctcctctcttacctgagaatcctgagagagtcgaggaggaaacctggtattccagagttaggagaaacgactgtgccctcatgtaccatgatggatactatcacagaaagcaacatgcatgctctcccaccatccacactgggacgtgagcatcactatccctttatcatcccaatggccactttgctgcagcaccaaccttgctgatgtgacccattctggtccactgctggttaaaaactcccctctgaccactgcccacatggttggatcagtccaccgtggacccaagatgtgactctcactgctttacactgccatgtgggactctataaggtcactactctcctgataggcatgtgggatctgcagtgtgggatcccccatgcctaccgagaaggagaaatgggggaggatataggtttaagtagaaattagacaagggattgggactagagaacatttctcctgagagttttcaaggaaaatgacttgcctggttatgttcaagcataaagtatataatacaatagaaaacagagtaataggagttaggaaacgtagtgtcttgtcttggttctttgtgtgaccttggggaagtcattttcagatgcttatttttccccttttggaatgctgggtaaaaataattgcacagtccatctcccaattctggttaagttcaaatgagatgatgtttggaaatgagctttgaaatcccttaggtgtagcattagcaccattaatatgcagcaccatggtaagaaaaaaagacagtctgttctttaaattggcctcaagaaaatttcacacctggatatctggtggaacctgcaaattggtgttgtatattttaaagtcaagagtaaccttggagactggtctagattgaaaatcaacagtacattggagagtgatacacagctcctagctggtaggggaaattgagggcatccagagtgaataaagtgtttattgcggtggagtgagcaggggggagtagcattatgttctaaaaacattcaataaaagaatagccaccttccgttttctcaaacatctatgcaggtgcttagatcccaaatatggaagattttgcatttcacaaggtatctttcattctacatagatttgtagcaaaataaaaatcattatacattttaatggctttgttgatttggttaaattagctgaaggcattgttgactgcacataaaatccatttctcaaagttctttagctttttgaccctttcatcaattcttcttcagttctgtcatcattctttccctcctctttcaatttcctatctaaaatgttccaaaataattataaaagtcagagaggcatgatgaacctttttattggaaagagatgaaccttccaaactcattctcagctcatcatcacagcatttggaatatggagtaaaaattcatattttgcaagtgccttggtgcttaagcatgcagaacagatgtttcatttcacaagttttcccaatttattacacataatatctctatttctgtgagacaaacactgctttggggaataggcctctccatttcctccagcaagctaaggcatggaaatggactgttgagtcaccttctagtcacctcaggagaggagatttttcaaatgctgtttgtttattttcatgcaaggtcatcaaggggaaatagtcacagtcccatactccttaccaaaggccgtcacttctgcacatggcatttctctacctgaaatgcattcaattaaatgcactcatccttgctaggcctggcttgatttcacatctgtgacggattccttgatgaactcgacaccgagtggtttcttccaatagctaaataatacctgatgatgacattattttcatcattaccattagcaacttaggagggagaaaggtggtgttgggcagggaagtcacactaacctcacctttccctgttgcactctaaattccgagggcggggtggcttgcacagtgcctttcatatgattggtgttttaaaaacattgcttggttgattacataggatagtattgctgctttggtagcctaactttgctcctacactacggccagaagagagggtgaagaagaaataagaaaataaaaatcaatcctaaagaaagtggtaaggagcaaaataggagttatcggggaagcacaaaaacctgaagcagataaccctcaggcgtgaaggcctatttctctcctggtttacacacgcacccacctccgtttctctcctacttctccgccaccccacctcaaccaggaggcaattccccaaccaaccctgaatatgtcttctaatttcatgtactcaataatacccaaaccatttaatctcagtcactgctggtgggagcggcaattgacacgaccttgaagggaaagcaacttggcagcagatatcaagagttctaaaaaacatttatactcatcttctccataattccacttctgagctgtatcctaatttttaaaatcttaaatatgtacaaagatttatgcccccagagtttccaatacaggtttatttatacagagataggaacagtgcagcagtctagcatcagaaggagtggctaaattatgggatgagtctctcactggaatttttctaaagttattttaaattatgtcttaaaggcatttaaagcttattttatttttaaatgtttttaaattagcatgcaataaaattgacctttgtctacacagttctatgaatttcagcactcacatagggtcaggaccgagtttcctctcacaagactcctagccccaccttgaaatcaccggacgcgcttcgttgtccaggagccttctcgaagcggcgggacgtctccggaggttgggtggcccggtcagtccgcggcacacaaggacctctagggggcagtgttgtctcacaccacatgttcctctaccgggctttaacacacacccttaaactctaacccagccaaagcactattgcgtctgtattttccaaatactttacaatgagtatgcactactattacaatcagaaaaaaaatattagattactaataagctattgaaactgggggagatagcaatataaaaatacccactcatggaagacactgcttaaaatagagaactagcctctgttcatagtctggtttcaaagcccaaagttacgtttccttttgttagattgctagatgatatggctctggactttaattctccatgtttaaaatagcatttctgtatttaaaatagcatttcaatagcacttttaaaacttctaaaatcatttctgtaatactcttttttcagtgagaaatagaacaatgcttcttccctctctattttagagatagcaaagcgctaaagagatgaatttgtgttagaacatctatatattaattcagaatatcctaataagcaaaaggatattgctaacaatttgtatgcagcaaggcataagttttggagtcttctcaatttagctattccacttatgctagttcacccactcccttcctgtgacgggttccctagtgatgaatggggcatgtagattatcagatgagtggacaggaaggaagacagtctagagtggaagataaagataaccaacccatgatggaaccaactcagaaatcaaccccaccaagagaaaactttattcatgcactgaatatttatggaacacctttcacttgccaagcactgttccaggtgctggggatatagcagaaaactgcacgtcaaaattgctgctctcataaagttcacattctgggactctaacccagccaaagcactattgcgtctgtattttccaaatactttacaatgagtatgcactactattacaatcagaaaaaaatattagattactaacaagctattgaaagtgtctcccactgggtgggagacagctaggaaaaagaaataaagaggaaaaatatcctcttgaaagttaaaataggatagagacggattggtgggggctactttagactgcggagtcacagaggacctctttgaggaagtggtaatttaagatgagatcagaataacatatccagccttgagaagacaagggggtggagggagtgttccagggaaaggagacaccttatacaaaggctggaacaaattgaatgggttcagaaaacaaaaggaaggcccagagtgactggagcgtggcatttagggatgaaggtcaagtcagaaaagtatgtaagagtctggtcaagtaacagtctcgtaggccaaggtaaggaatttgggttttattttactgcagtgagagatataggagatttcacacagaggcgtgaaatggtctgatataggtttctaagaaccattctgatggccattagaaagtgcaagtttgggaatatggcgatcactgagaaagctatgggaccgtgcatggtagatcatgcctgtaatctcagcacttcggaaggccaaggcaggaggattgcttgaggccaggagttcaagaccagcctgggcaacacagtgagacctcatcgctacaaaaaataaaaacataagccaagtgtggtggcatgtgcctgtagtcccagctactcaggaggttaaggcaggaggattgcttgagcccaggagttcaagactgcagtgagctatgattgcaccactgcactccagccagagcagcagagtgagaccatgtctcatataaaataaaataataaaattcaaataataaaataaaacagaaagctatcacaataactgaggtcaggtgtgatgaagtgtggaccaggattatggcggtagagatggaaggtagctcacagagtcatgacatcttttggagaaggagctgttggaattagctgtattattagatgtacatggttggggggagatgaatcaaagcacgattcctagctttttagtttgaacaactgaaaggatggtagctccatttccggagatgagaggactgaggagatcatgatccggggggaatatttggtctttaacatgtgagcccattggacgagcatttgggtaacttcagtcttactcctcagcagctgctgttggcagggtgtggtcaggtaggctggcactgtgtctgagcaagccagctctggtctgataacagagttttatctggaaggggaaacccagggctgggcttacgatctaaggtcagcagcctgtcacaccaagaaataaacatctgttaaggcaattggtacataagcactcagaaagtgtagcttgtcaaagtggcttaattccaactaggttgttattactcagttgacacctcttgggagagttttttgatattttctttaactctttagtgttatactttatgtatattcacatgaattgaaaacaggttcagttaaaagggtaattaaaaatataaaacattttttaaaaaagaaaacagggccaggcacggtggctcacgcctgtaatcccagcactttgggaggccgaggtgggcacatcatgaggtcaggagatcgagaccatcctggctaacacggtgaaacctcgtctctactaaaaatacaaaaaattagctaggcgtgatggtgggtgcctatagttgcagctactcgggaggctgaggcaggagaatggcatgaacccaggaggaggaaggagcttgcagtgagccgagatggcgccactgcactccagcctgggcgacagagtgagacactgtctcaaaaaaaaaaaaaaaagaaaacaggtacatgatgtagactctacattttaatgtaatgtttcattaattgtaatgaaacattacaatgtttcaacatccttgaaatttaaataagggaagctttgggtttccataaagagaacacttatacttaaacacaagaaggctgagacaaaggttaaaaaatggtaaagctgtaaagggctgttaaaagcataatgctgtatttttcatcccccaaatcttaaaatgtaaaaaaatggctttagcttttgactccaaagctggagattaattttttaatttttaatttttgtgggtacatagtagatgtatatatttatggggtacatgtaatattttgatacaggcatgtaatgcataataatcacatcagggcaaaaggggtatccatcacctcaagcatttattttttgtgttacaaacaacccaagtatactcttttaattatttaaaaatgtacaataaaattatttttgactatagtcactctgttgtgctagcaaatactatatcttattcatcctttctaactattgtttgtactcatcaaccacacccacgtacccccgactcttctcctactcttcctagcctctggtaaccatccttctaactctctatctctatgagttcaattgttttaatttttagctcccacagataagtgagaacatgcgacgtttgtctttctgtgtctggtttagttcacttaacataatgatctccagttccatccatgttgttgcaaatgataggatctcattcttttttatggctgaatagtactccactgtgtatttacaacctttcctttgtccatttatctgttgatggacacttaggttgcttccaaatcttggctattgtgaatagtgctgcaataaacatgggcgtgcaaaactggagaattttgaagtaatacatttactcctacagagatcctgaataatcatagttcttgattacacccacctcctcttcattattttaagtatttttgttaattactaagttgatccttctagtaaaaaggctgccacaacttcgtttcctttggaggactgagaccttcccaccttagcaagagctttccatgttgaggtttgcagtgagagtcacattacccagagaactgaggggactgcagttatgcccttgcagatacgggaacacgagggctgaattaatgagccagagccatagacaatactgccaaaaagtcccaagttcccccgagcaaatacccaggaaggatttgtctggatatcaccttcacctcctacttagaacagggttgccctgaaagtccctccacccatcgcaggagaagaccttggagagtggctagcagaattcaggcaaattctttgtttctgcattctatttgagcagcctggccacaggccaaggaaaactctcttggagaatagacattacctgtggagaatgatttgagaaactctgatccaggaatatccaacactacagtggcctcctggggtccctactaaccggtcccctattaatctccctgccctgatttcctaccatcctctccctcactcactctgctccagccactctggccttcctcaaaaacagacagacttctaccttgaggcttttacatttgcctagaacactctctagcttgctcgtttacctgcgtcatgtcttggctttcatgccactgtttgaacaaggcccacccttattaaccccaatcaatattgcaaacttccccttcaccactcaccctcaccaccctcattattcagctctttttttaaaaaggtacctattatgttctaatacatatcactggggtatgttttatatttattgtatattgtctatctcctcccactagaacacagctccacaaagggtgaaatgtttgcctgtttcttggttgactgctgttacccctgggcctgcatcagcacctggcgtatagtagactctcaagaacagctgtcgattaaatgactgaatatagcacatctgggaaaacaaaggcttgatttggtccctgttttcaacactagctctccctcccccaggactggtcctctcctagcactgccagcctctgccagtccttagtgggacatgacctgcccttgcccacacacctactcgatcctcactcagtagtcagcatccatatcccactgtgactgacccaggcacacagtgccagcagctcgtccaaactggaaactcttcaagtctcaaagtcttttatcagtctattacttgtccctgcattctctcttctgtccccctcactgtagaccttcagacactcaccaatttcctgttccctctctcagtccctgggaagaccggcagtggggtaggacgccaatctccccagctgctcttccaggctcccctgccagaggaggcctttggtctgtgatttttctgccaattattagaaagaaataggcctgggataataaaaacaaccaaggaggaatttaaaaggttatgaaatcttttaaaattctgttttctcaattgtattttctcatttgtacttctcggctcttttttgagacgtttacatagaatcatcatctttccttatatactcccttttggaggaaaaagtactttcagagtttctcaattatgtcaaataacagaaaacatttattgaacaattactatgtgctcagcaccataatgcatttctatgaaaatgagctcatttaatcctcacaacctctcggtgaagtggatgctgtcaatcttcccatttcatggaggaaaactgaggcccagagaagttatatgactcccgagtttacacagctacctagtggaggactctaagttacaacttatctaatttgagagttcaaattttcaactgctataaaatatctctgatacatgagagaagctggaaagtgagatcataaccaccagaaaaatactacttgttagtgcctcagaagaactaccactggtgtgagtagaattacaacactggcaacccaaaagagatacgcatgtcatgttgtctgattttggagacattcttaattttcagtggcaggtgccatacatttattcattgagcaaatgttttactgagtacctttaatgtgacaaaaagcctggccactgcagaaacaggtgagcaaaagcaaacacagcccttgcattcatacaacatatatttcttcttgaaatcaagttcctggcactaggtatcaatagacttgaaaatatgcataaccagctaggtgcagtggctcacgcttgtaatcccagcactttgggaggccaaggcaggcagatctcttgaggtcaggagtttgagagaccagcctggccaacatggtgaaactgtgtctctactaaaagtacaaaaattagccaggcgaggtggcgtgtgcgtgtaattccagttacctgggaggctgaaacatgagaattgcttgaaccagaaaggcagaggtttcagtgaaccaagatcatgccactgcattccagtctgggtgacagagagactccatctcaaacaaacaaatgaacaaaaaaaaaaaaaacaagaaaatatatttagcctataaccaagaatctcatttctagaaataaaaataatctgaaacacaaattaattatacatatttatcagagcattatttgtaatagcgacaaattagaaacaactcatgtccaaccagtccaactcaatgattaccagtaggtaaatcattaggtaagttgtggtacatccacatattgaaatagtcattcataataatgttttcaaaaagttttaatattatgaacaaatgcttaaattataatgttaaaaatgagaaaagtaagctataaaacaatctgtttagtatgctttttggtacataaaataatatatatgacattatttggatatgttcgagtaagctatatgatattaacatttttataggtcaaaaggatcaaatatcaacaatttcataatggaaaaaatctgaaaacaaaaaagccaaaatattaatggtgatgatttcttggtggtggtatcatcagcaattttcactcttttccttctatttttggcattttccagttttcaacaatgtacatatatttctaataaaaacattattggaaaacaaaaagagaacaaatgttcctctttcagctactttactaaatcataatgctaaatgcagtctgactgagtacctataatccatcatgccagtaactgcagcaaatgtagcaatggcctgtaattccattttatacatactgcaatagatattcagcccagaacgatatttcaagacagcagtttctgaagcagggagttggttcagataaaatagatgccagactatcagtgcttcatagccttagagataggttgctaggacctaactcataacatttccaagaaagctgcataaacttcttattgatgatctcaattacttctaaagcatttttgagaaaaaatatttttaggaccaaaataaaagtaggttataaagtcctagctcttgaggacaatggggagagaaagattttatatgctggaaagaggggttttttttgatagattatctgaaataacatatccttcattagtcagtgctaatgaatagtcacatctgttttcatggaacaatggagaattacataattaatagtttattcttttcaaaatttaatataactgctccttttacacttacttttaactctgtaagttattctcttactgtctttatatgtaatataggatacacttgcccaaaatcttgtagaatacatgagaatatacatacactaaaatgtgtatgtacacatatatatgtatacatacacacacacacacacacacacacacacacacacacacacacacttcacagtttaatgagtgcttactatatgccaagtactatgttgagactaggtatagaccagtgagcaaaactgacatgtctcttacagcccagtagcagagacagacaaacatgcaaatatatgcaaaattattaattgtgagaaatcaaatgaaagccaagaataggacactgtaagaaagaattcggctgaaggagaattagactggagagaacttggaatctgaatcaacataggatgatgtctctaaggagaggacatttacacaggagaatgagtggaagaaaaagtctcctgggcttaagaaaagaaggtcctgactcagtgataaggagttaccagtattaagagaaggtcagtaggcccagtgttttcttgagcaaggtagagggtcatcaaatggtgtttggaagggaggcctgggccatgtgactcagaagtctacaggtcctgtggaggatttatcctaagtagaataggaatgtgctaaagtatttgaaacagggaatggcatgactagagaaacatttttaaagcattattctactgaagtattctactgggctctaatggttctactattgtattgggtgaaattctgtgatgtctggtgtttgctttaataaatattccagatataaagaaagaaaatgtgggagtgccaagggaaatgataacagataaaataaaactgtcaaaatattgaaagttgctaagactgggtgataagtacatgggaatttgttatacatctccttgtgttttggggtatgtttgaaattttttaaaataaaaagctttttttcaaaaagataaagagtgagctttggctctgagattaccagttcaattctgccacttactattaggtatgtgattttagaaaagtgatttttcttctataatctttagttttcacatgtatggaatagtgataatgacagtacatacctcataggcctgttaaatatattaatgcaataatagcagagagtttggctcatagtaaaaatctggggaatgttaactattattttagaattaactccaggcatatttattgtgtgtatatatatatatatatatatgtgtgtgtgtgtgtgtgtgtgtgtgtgtgtgtgtatatgtgtgtgtgtgtgtgtgtgtgtatatatatatatatatatatatacacacacacacacacacatatatatttgttttgttctgttttgagacagagtctcactccatcacccaggctggagtgcactggtgtgatctcagctcactgcagcctctgcctcctgggttcaagcaattctcacgcctcagcctcccaagtagctggaattacaggtgcatgccaccatgcctggttaatttttgtatttttagtagagatgggggtttcaccaggctggcctcgaactcctgaccccaagtgattctccctccttggcctcccaaagtgctggggttacaggcatgagctatcatgctctgcatatatatatgtatatgtatttaaaccattctggtgtctgtatggaaaatggatgggagcaatgaatggtgacgtaaaagatcagttaagagcaattggtgagttcagctgagtagcactggagcaatggggaaggagtgacatcgattaaggagccgctggaaaatggatggtgctgaaagccctgcaaaaaaccaagatctcctgagatagttcccaggggttcttgactcctccaacttttttttttttttttttttttttttgccatggactcctttggcagtgataaagcctataggctccttctcagaatgatgttttaagatgcataaaataaaaggcataggataacacagaaaattatcttgaaatacagttactaaaatgtttaaaaagtaattttcgatatagtaaaaagttttttaataatgtattaagtaactagatgcatatatatttcaagctatctaagtataatgtgacataaaaatattgattctttgtattagtaactgtcacagttcagtttccccagaaagcagaatctaagctggagattggcatttggggagtttgctagggaacgctcttgacatcaacatgagggaaggcaaggtggaactggtcagagaaggatgacattgagctgtgatgaagtctgagaggaagcttcagccaaccttacagaaggtctgaagattatatgacccttcagaagtgccctgaatcaaagagggccaggtgtttattacccagctgaggtggctctctgcaactgaggccatttccctggggctgccagctgagggcactctgccaacagctttcatagtagctggggtaagtcctcatttctgaaagaagatctaggtgtaacattataacatcaatcacagtgacaaatttataggttctgcaagttccactgtggcttgctgcctacattcacagttgaagaaaagactgaatttcggttagagattagtggaaatgaaaatgtaattttaaaatcctatccaaattcacaaaccccacatggaccccaggttaagaatacttgtgagtgagaatggggccccatattcagagaggctggtcaggctctgttgtttgctggaacacagtaagctgtcttctgctgtagggaaaaatgagcagattgaacctaagcattaaaataaaaaaatgagcagggaaagtgtgttttccagagcaagaatgatgcccaggaacaaagcaagtcagacaggatagagtccacagtaccagagaaaagacacagattgatgtgcagctgcctgagtctacttttgaattacagattttaatccttcatgaaaccaaacaatacctccagttcttggtgtagaaacactcctatgtctttataatgttattttctcatgtaagctagtttaagtaggtttctgctgcttacaagctgacgtatcttgttgaatacagagatactttaaaactcctcccttaacacacacatacacagaaattcttgaaatttgcaggagtttggggtgaggagcatctagcaaggaacatggagttgggaatggttgaagcattgctgctgggatctattaaggctctgagctctccatgaaagtattggctttctctttgatggcctttgctgtattggataactcacctacaaaaatgacttatttttaatgtagaactgtgataaacttcaacattttgatgattatcatgctttaaaatgagaataaagatagctattatattttttaatttgacagagtagtgcaggcaataatgaaatggtattcatctgaatagcaatctttatttttaaaatccaaaggcactcaataatgtgatctgtgcactttgctattatgatatatagcatataaaatgttaagcacgtctaacatttaattcatttcaatcataccagtctgtcaagatataataaatcaacaaaaccaacaactccctcccaaacattaattacctagtgaactactcttagcttttttatttagtcatgaaatttgaaaattacctctgaattagcatagctattcacacattattttccccaacaacaaaagaaatgccactgtaacagctgcttcgtactttttaacatgaaattgatgttagtgacagattttcaagcatgtaatttgtctcaacatgtgtgtccttttatttgtaaaaactcccaggactgaagaatgaagtttcaaaaagttatttattgtgtctcctggcagggtagaatccatggaaaacaatcaactaacagaactgtgtgatggtctataagatttggaattataccattgttatagaggggaaataaaagacatttctcctgtaccagcttctcctcccccaccacccctagtaagaagtggaaaatgaatataccaaatgaacatacttggatttgattttatgatttgatttttatgatggaacgtcttgtaaatgggagcagattcctaaaaaaattacagtgccagcccagttctaagcactgcatccccaattactttgaaaagaggctcttgtaagccaactgtgcagtcacctctgattataaggtttggaaggagtatcttccaggacctacccttagcctgattcagcagatgacaatccatttccttttaaactttttttttgcatcagaagatgcagtaagttgtaagtattacacagaatacttaggcacagaaaacacaataagtagtaagatgtgtctcttaaggggctcacaattaagtatgaaaagagattattagagaaacaaagagttaaatcttctaatagaggtggtggtagaaaggtgtgttgtaaccagtctctggtcaaaatgaaaccaatttcggctagaggaagcagggatctggttatacagaacccaaaggacttaaagttggtgaaaaaaggaagcagcaagtagagcaaagatgggttgtccaactccccttgattgcactctctccaggggagggaacaataaccccttactccttgagaccagtcaacatgtgtttgcccttgagatagctttccctagtgtctctggggagctaggaaacaacaggttagggtctttgtaattcttgcctctgccagggccttggccagagatctgggaggacaacagactcttcccctatgtgctgctagaaaactggttgtaatactgttttcttttctttctttcttaatttttttaagagacaggatctcactttgttgttcaggctgtagtgcagtggggcagttgtggcccactgcagcctcgaccccctgggctcaagtaatcttcccgcctcaggctcctgagaacctaggacaacaggtgctcactgccatgcctggcttttttttttttttttttttttttttttttaatttttggtagagacagggtctctttatgttgcccaggctggtcttgaattcctggcctcaagtgatccttctacttcagccttttaaagtgctgggattataggcatgagccaccaagcccagctgcttgtaacattcttgaaatgttgaccccactggagtgaccagcagagcttgccatgcctcccgatctgtactctttgctgtagtttagatatttgtccgcttcaaatctcatgttgaaatctgatccccagtgttggaagtcgggtttagtgggaggtgtttggatcataaggatggatccctcataaatagattaatgccctgccatggtgagagtagtgagtgagttctctattagttttcccaagagctggttttttaaaagagcccggtgcttccctctctctcttgcttcctctctcaccctgtgatttctgcacacactggctcctcttccccttttgccatgagtggaagcaacctccagcctttacctgatgtagatactggtgctgatttttgtacagcctatagaattgtgacctaaacaaacctccttttctttataaatcacccagactcagatattcctttatagtaacacaaacagattaagacacttcccacccagttgtctctcagacctcattacggttattcttcttacatgtgttccactttagctgcttgggtccccatgcttttctcaacacacaggctggtgctccttcttgcctttgcattgtcgtcccctctcctgggaacatgcctcctttagtgacctgaatggctcaccacttcacctcctgtaggtctttgctttggtgtcaccttctcagtgtggcattccctggccatcctatttgacactggccctacttctttccagagttctatctttcctgcttgattttcctctgttgtactcatccctacccacatactttgtattcctcttttttaatttgtttattgccttttttcctcctttagaccacaagctccatgaggacagaaattttgctctgctttatcccctgatctctccccagcacctagcacattgtacctggtgtataatacatttttttaagatctctccccagtacctagcacattgtacctggtgcataatacattttttttttttaagagacagggtcttgttctatcacccaggctagagtgcagtggcatgatcatagctcactgcagcctcaaactcctgggctcaagcaattctcctgccccaacctcctaagtagacgggaccacaagtgtgtgccaccatacctggctaattttttttttttttttttttgagatggagtctccgctctgttgcccaggctggagtgcagtggcatgatcttggctcactgcaagctccgcctcccgggttcatgccattctcctgcctcagcctcccgagtagctgggactacaagcgcccaccaccatgcccggctaatttttatatttttagtagagacggggtttcatcgtgttatacctggctaattttttaaaaccatctgtagatatggggtcttgccatgttgcccaggctggtctcctggcctcaagcaatcctcctgccctggcctcccaaagttctgaaattataggtgtgagccactgggcttgcctacaaatattttaaagagttaaattaaatatatatacatttcaaaacttttcctttttgtagaatatgtgccccaaacggccaatattcgaactgttttctcactatttttttgtagggtgagcttgctgatagccatatgtgctagccaatactggattttctgatgtctttattcatttaaaaattatcctttatggtgactttattactgagctctcctcttctgcttgtgtactgtgcagtctactatgggaggagtgagtccagttaaggtgcccttctttaaggggaggcctgctaagtggatcttctctagatagtgaggagaaccggtgagtgagcaatctagaccagaacacgtataatactggaggggtctttagcccagagatttacaaagaagaccaaaggatttatcagtaattaccctatctatgtaatacatgtagataaagatagataggcatgtatatgcatatatacagatacctatgtatatatctatctatatacatatatacatgtagatatatacatacctatatacatgtagaaatacagatgtagatataaatatatatatgtgtatagagatatgtgtagacatatatagatgtatacatatatagatagataggtctatatagaaaaccatctatctatatctagatagagatatgtattgatagatatctctccctatctatctctagatagattatctaatctatctgtaaaactatcttaaaaccatactaatttaaaaatcaagattcatcttaatttaaaaatcttaatttaaaagttaagaaccatctttattttgtggttcatatacaccatggaatgttaggcagccataaaagagagtgagatcaagtcctttgcaggaacatggatggagctggatggaggtctttatccttaacaaactaaggcaggaacagaaaaccaaatactgcatgttctcatttacaaatgggagctaaattatgagaacacatgaacacatagagggaaacaacagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaaaattattaaaaatatgtcagtaaaagtctttaaccaacaccaaatggttcatcccaagagtcatcttaatttaaaaatcttcacatcttaagaagctacatgggaggctgcggcaggagaatggcttgaacccagcaggcaggggttgcagtgaagcgagatgataacattgtactccagcccaggtgacagtgtgagactctgtctcaaaaaaaaaaaaaaaaaaaaaggagcaactttgctgcttaaattgagtataatacccatttacatttaatgtggtgaatgaaaaatttggttttcatttaccaccctacaactgaatttttaattcctccacatattctatttgcctttctcaactattattttatagataaaaggacttacagaaagcaaatacatgactcaatattccaataaaagtgctttttaaatttatattgagcattttatccttctttcttaaaaatcttaagctacacacattacatagctaggcaccgataagaatctagtactagataaccatttcaaaggcatggatagaatgctttccaggtatggattgtttccataactccccttccatacattttaaagccattgcataaaaaataaggaattttgtagagaggagtgagtttatatcctttaatattttctcactttagaagtgcagtcttggaatgatataaactctgtaaacagactatcatgctacatttacagagaattatatcaaggtgtctatttctaagacaagaataaaaattatgtttttttctaataatagaaatggataagcagaattctggcttctaataatgagaacatactatcccctagtttgaaataagttagataatttaactttctcatgttatcttgaagttaatacatcatttatattgaatatatcagtgcactacatgaagttgtacattgggtaccatcccttttatcttccacataaagtgatttagtgttttaatacacttctttccatatcctgcagttttgcatagcaaaagaagcatgcactttgaggaaaatgtaccttttaattttctgtattttaaatattatgggtacaaaatatttgtatataattatggagtacatgtgatgtttcaatacctcctttttgatcccagatctttcctgaattttttgtccaatttgtattgcgttatttatgtttgaaaaggagtaatgatgtttagtatatactgttataaaataactgattcgaaggatgtaaagtatctgatactatgtccaaatatgatttttaagcaaatgttcctaacaatacataaataataacatggaataataaaataacatggaataaaataaattcatatagctttatgattaataattttacctaaattaaaaagtgttatgtgcaaatagatggtatacgacacttggcatgtaataatgcaattaagtccaattgaatatattgcttgatttatttccacaatctttgatacatgtattgtatatccaaacatcaaaaaccataagcagcctgtataatgccttttttattctctgtaaagtttttaatataaatatataaaagagcatcttaaattatttaaataagtcaattattttatatgtggatttggtattagaacatatatcttcttttgcacaataaacttttttaagtgtcagaaattatataattatatagtgacttttgttcacaaggtagttagttgtacgtacctacaagatacttgaaaaatatttttgccgagattggatgcatttttctcttatagactcttaaaaatgttaacaagccaacacatgaacgtactgaagtattttttaatcatcttttctagtgttgataatgagttggctgatataaagtcattagagtggcaattcaacaaatattttctatggcataacaaatgtcattaacttgctagtctgtcatgatgttgcaaagctaaagtcacattcattagtgttttttgttgttgttgctgtagtggtggtttgttttgttacatgaagtggcccacttcttgtattaaattatttattctttctgaaaatgttcaatcagaatgtaataacacctttaaaaatgatttaaaaatgtattcccataggtgggaattgagcaatgagaacacttggacacagggtggggaacatcacaccccagggcctgtcggggggtggggggcagggggagggatagcattaggagaaataactaatgtaaatgatgagttaatgggtgcagcaaaccaacatggcatgtgtataccaatgtaacaaacctgcatgttgtgcacatgtatcctagaacttaaagtatattaaaaaatatatatatttatttctactgaacacaatgtctatatattagatgacctagaactggtagggggttctaatccaggggattgttgataaactcagacaacttctataatttttacattgttactcttaaagtcttgtcattgattgtctcaatattggaaaataacatgtcaatattcagtgtaataaactggaagaaaaaatgggccaatatcccattcaattaaagacattaaaaagagtgtgtatgtattacttctgctcacatcttaatgttcaacatgtcgtcaccaagccagatagaaccatatactggggaatgtaatgtttatctgagaaaccaaatgcctaaatacaaattttagtagtacgaagtaagaggaaataaatatgggggattttctagtcttctctattatatataaattgcaagatttggctactttaaaaaatattaacatttactaatttttcatcaattcaaatatcatattgtagagtgcaatttaatcaaattagataacagtcccaaatataacatttaactgtacatcttccagaagccaaaaaatgagaaattatttgtggcttttggctagacaaagatttcttagatgtggcccaaaagaacaacctagagaacaaacaaaaaaaccagttacaacaacaataaatatgacttcataaaaacaaaaaattctatatttctaccctatatgcctcaaactaggaatagacatttccaaattatatctgataaagaatgtgtatccaaaatatgtaaactcaattataaggaaaattacagaccaacaataaacaataaggaaaagaatatacttgaacacatactttgccagaggaaattcagagacagcaaataatcacatcaaaagatgttcaatatctttagccattagagaaatacaaattaaatgagatgccattccacacctacatatactttgccagaggaaattcagagacagcaaataatcacatcgaaagatgttcaatatctttagccattagagaaatacaaattaaatgagatgccattccacacctactagaataaatacaattaaaaatactcatcatcttttgtgttggtgatgatttagaacaactgtaattctcaaatactgatggtaggaaagtaaaatgatacagccactctgggaaaaaaaaaatggactgtttcttacaaagttaaatagacccccatcattttacctacttattctactgttgctctttaagcagaaaacagtatagcatatatacatacaagaatgtgtttgcaagtggccatgacaaacttatttataataacactaaactgtaaacaacccaaagtttatcaatgggtgaataaataaaccaaacacggtatactcataacgtgagatataaccacacacacacacacacacacacacacacacacacacacacacacaaccatattttcaacaaacggtactggaacaattggacatccacatccaaaaaaaaagaatctagacactgtgtttacacaatgtacaagaatggataatagatttaaacataaaaatgtgagactatagaagaatgttataagttgaatttaataaaaattaaaacttctgctctaagaaagtcatagttaatatttaaaaaacaagccaagactgggagacaatatttacaaaacatgtatccaataaagaactggtatgagcactccacagaactcttaaaactcaaaaagaaaaaaaaaagataaataatccagttaaaaaatggacaggagatctgaacagacatttcaccgaggaaaatatattgatggcaaataagcgaatgaagtatgctcaacatcatgtattattagagaatcgctcattcgaacgagataccaccgcatgcctactaaaatggctaaaatccagaacactgaaaacactaaattgtgttgaagataaagagcaagggaaactctcatttattgcttgtgggaatgcaaaatggcacagccacgttagaagatagctttgcagtttcttacaaagttaaatgtagtcttaccacatggactagtaacttcactcctatccaaatgagtcaaaaaaacttcactcctatccaaatgagtcacatgactccttaaaatagcttttctcataacaaaacttggtagctaccagatgcccccaacaggtgagtaatggttcaataaactggcatacctataaaatgggatattcagtgatttaaaaataagctatcaaaccatacaaaacatgcaagaacctaaaatgcatacaacttagtgaaagaagctaatctgaaaaggctgtacactgtataattccaatgatacaacattcttaaaaaggggaaaactgtaaaaagatcagaatttccagtagtctccaagggaagggatgaataaatcaagcacagaaatttttaagaaagtaaaactattcttataatattgtagtagtggttacatgacatatgcatttgtccaaacgcatgaaatgtataatgtcaagagtgaaccctaatataaaactaatgtatggactttcatttataatatgtcaatattgatgcatcaattataacgaatgtaccacactaatccaagatattaatcataaagaatatggagagtagaagaaagtgtatggaaattctctctgctttgttagtttctactataaacgtaaaattgttctaaaaataaaatctattaattaaaaaaagaatgaactattgctaccagtatcaacataggcgaaagtcagagtagttatgttgagtgcaaaagacagacaaaaaagaatagattttgtgactccatttacataaaattctaccaagtgtaaaccattctgtagtatcagaaatagattagtagttgcatggagattgagtagggaagaggggaagaagcgattactaaagacacaaaataacttcagggaagtgaatatgttcatgatcttgattgccatggtgttttctcgtgtaccaatatgccaaaactttaaaaatacactggatatgttcagtttatgtcaattacacttcaatgaaaaacattttaaaatattatgtatcttgattttatgcttatgcagagatattatttctctgcataaaaaaggtatatatgcatatatgccatatataccttttggcatagtgtaaagatatataaacatagtatataaatatggtatttgtaatattcttattcatatgcaaaatatagtttacttttaattttttaacttttcttctgtttttattccgtatcctccagacattaacactgagaacttcatatacaattacatatttaaaaatgagtcatgtctagtataatacaaaatatcagcaatgtaacgtgacaggaacaaaatataaatgaagttgctttgtatagattcatttttctcattaaaacatttcatagcataatgcacttattcaaaagtattaacatatatatttaagtgcactatgaaaaacagaatcaagaaatggataccatattgatactaaatcctatgttaaagtatgttgaataattcgtagtttttcaaaagtaactcagtcatgtcacatattaataatgaatatatttatttttaggaactccttttaaataactattaggtatatagttttatgctgagttttatgagaaacacaataagcatatcattttatgtcaggaatagagagtatatttgtccctaggtcattttctatagctgtcaaaatgtttcaacatcttttagaactccagaaaatgaggaagaaatatagaaatgttcctaggttgttcttgtaactttatctagtttttttctattcttaattatattaattcttcccaatggcttatttaaaaatgggtcttcaattgtctttcattaaaattctatggggtctcattacgtgtaagaaggttttatttcacaccaagtatttttctgttatgtaaaaggaaaataaagctctgggctaaagaaataacttttttaaaaaattttccctattgggaagtagttgaatatatactttgctgttttcagctaaaacatattagaatgtgattctatttacaacaaaaatgaaataaggctgtgttacattggcaagctgtaatgggaaatgtatttgtcaccctaggcaaactgaaagggcagatatattgaattcagtaatgctgaataattaagccctcacttataacccttatattagagaattcaacttaataagttaagtcattttccaagtgtttgttaatgtatcaaaaggatttatacatttcacaaagggggactcaagctaagctaaagatttataaacacaaccaattcactagagaaataattttaaccgtgtttttcttgtttttccaaaccttactctttcatggaaaaaaataaaggcaatattataaaatagatgaaagtgcagggtaattaccttgcattgagaagcctagagctcacctgatccacaatatttgataatccatgtcacccctggtttacttccacagttcccttgaagattgaagagctgtctgaataccacagtcttagtatactatgttttgtaaggaaacctgcccactcaagaataccttctatgagagccaacccattcagcatgttaggaagtttgcttccatgtatgattcaagcccacctggtccagtggattggacaatgaatgaacgcttgatttaggtggaagttatccatttattggttggaaatcaataagcctctttcacttgagaattctaattgagatgaaggttataataatgatgcatactggatgcacaaagccatatagcctccataatgttataaagaataatattattgatccacaggcaagcaatggagatacaaagagtacaagagtaagaaaataaatgttgccctggagtgagagaaattgataaaaagccactgccttgatgttggacaggttcttagttctatgttcagcctttattttctgcccttggattctacactgtacatttcaagtttttttacaaaatggttttgactacagaaaaagcaagtgtgccattatcccatttttgacatattttgggagaaataaagtaaaaactatttttttaatatttatttatttatttatttatttatttatttatttatttattttttgagatggaatttcgctcttgttgcccaggctggagtgcaatggcgcaatattggctcactgcaacctccgtctcccgagttcaagcgattctcctgcctcaacctctcaagtagctgggagtacaggtgtgtgccaccacacccagctaatttttgtatttttaatagaggtggggtttcaccttgttggccaggctggtctcgaactccagatctcaggtgatccacccacctcggcctcccaaagtgcttggattacaggctccagccaccgcacccggccgtaaaaagcattaagagagtttttcagagtagtttctgagttacatgtaaaaacaagataaaaaaatttactaatagctctgcagctttcaaaattaagcagtcagatttctgtgtggctgagaattgctagcagtctcctccgttagaatttgccatgcccaaaatgtcccatgctatacagttaaatgattaatgtttgagtaatattcagtttgaaatttaaatttttcctcttgaggggaaaacatgcttagcctttcattataaaattatccaagctttcctctcatttctatgttcaaattcattgcatgagttaaagcatcttaaggcttccttctaaacaatttatatatttgccctacgatttcaactagtcctaatctcagaggatcacttcactggaaaagttgtgcaaaagtaaaacgaaatggagattaactatactaaattgtcatgttgagcttcgtgataaatttagttacaaagatattattcaaattggaattaactgcaaatctccccccaatgaaagtggagtgaaattggccgggtgcggtggctcacgcctgtaatcccagcactttgggaggccgaggcgggcggatcacaaggtcaggagatcgagaccatattggctaacacggtgaaaccccatctctactaaaaatacaaaaaattagccgggcgcggtggcgggtgcctgtagtcccagctactcaggaggctgaggcaggagaatggcgtgaacccaggaggcggagcttgcagtgagcccgagatcgcaccactgcactccagcctgggccacagagggagactccgtctcaaaaaaaaaaaaaaagaaagtggagtgaaattactatataaacctagagttatgaacatcagaaaacatgatatagcaataaagtaatttaatgttgacttagggagtcataaatcagatattttattcaacgaactctgatttttaattataacgtaagaattataaattagtatctaaaagtcattgtttcttaataaataatgagttgacaaaaataatagttgaaaaataaaattatataggatggttatattgtgaaaatttccattaaaaattaaaataataaaaaaatcgcctttggaaactacttttatttaaaatatcaggaatccagaaaattgcaacttttcttgatctacataatcatttttacatgaaattttaattccataaccattgcaaagatttttcttaataaacacagtattaagtatcaaacaccttctgtgaaagtacaatagaacacaaacatatactagagatattgttttctgcatttatgcatgaacaataagattttttaaatttttgacttatctgtggaaatatgatagagaattgtatggtatggtttaagtattattcatttctgcacttagatgaggtaattttttcttttctagataaactctaattccactttttccatacagtacacacatatacatgcatatatatgtttctgttaaacaacagtagtgagattttaacaaatgacttacctgtctttctgaaaagtgtcttgtctgttaatgtcatatgagcctgtaagggaagaaagggactatattacaaaggaacagaaatgatccaggagagtatgaatacaactggattctaagaatactgggctattgggtattgggatatagattgggataaaagagtatacccctatcagagcactgtcagtttcactactgatatggtacaaacacataacaggatggttcgtagcatcaaggaaaaagtgatggcctcaggtgaggttgcaatgtcaaatttcccatggaagatgacagaagatgcatatatcacaaagaaaataatatgtagaatagttaaaatctactctcaataatttttaagttattttaaattatatgctattgttattaactatagtcactatttccatagtcactacaactacaatcactatagatctattacataatgtacaatagatctctgaaacttatttctcctgtcaactgaaattttgtttcctttgaccaacattgagatagcaacttttatcacaatttaaaaattataataacataaaacaatgtaattttataacaaggaaaaggcatttcttgaaagttaattcacaaaattgaatgaatgaattgctaaacaaaacgatgtcaacaaccagaacaactctagatatctcaggcagaatgaattcaaagaaaacgactgcacatatttcttctcaacattagattcacaatggaatcacctggggcaatttttttttaaagaaacgaatgcctacatatcatgtccagactctgatttatttgttattaaatatggcctggacatcactctactcctgacgtccctgctcaagaatcaacttccgggaagagagactgggactcactgattttggtgctattcagttgaactatgcccttactgattttccacctgctggttctattcattattgatagagaggtgttaacacctccaattatcatagtggatttatctgtctgttcctgcagttctatctgttttcacctcatgtgttttgacagcctgttacatgcaaacacattaaggattgttacgttttcttggaaaattaaatcctttgttactatgtaatacccctttgtatccccctataattgttctttctctgaagtctttttgttggaaattaatatattaatccagctttcttttaattagtattatcatgttatatatttttcaaagttaattctcaagcttgtccacaatgtgcttccagaaattaatcaactgcatattaaagttttctactccattactaactcctgtgggggctcctgggcttttgctccactaggctataattctttgcattttcccatctctctaatttaatggggatttagggtgggcgcagcagtttttctgtgacctcagtcctctaatggatctaaaatgagttgttgatagtctgtttgtacagcatttttcttgttgtaaggatgggagtgatgactttcaagtttcttacatacttgaataactgacattttttattatatactcacccctgtggtggtagaagaatgctataaattttggatccacagaactaaagtactaggagagggaatttttcacaggaaagatggttgctacagaaaaaaaaagataaagtcttctctgctatctctgctagactctctaaactcttcctgtctctggagtccagacacccaagcctccttttagttttgagctttcactatgcttttatcttaaagactttgcctactatgtcttttctgctgagaaagcaccttatcccctcaattacctggttaacatcaaatatcaaatcatgcttctgactgaaggccaagtaccacctccagaagaaatcttccctaagaacagcctacatacagttaattgtgtgatcccttttcttatatccttcgaatactcttccttcacattactcttccttcacagcctttagccagacaacacattacaggaaaacagggagaacatgattttgccattcactcttacctttgcctagcccagtgcctggcaaatgatagattctcattatatatatatatatatttgaatgaattaataaatccaagtaaagtaattgatgttttggagttatctaaggctgttaaagtcagttaaatatagttaatgtgaagcaaaaaaccgtaaacaaaattaacgtaatatacacgctgatgttactattttagaaaaaaacacaataatttacaaattcctttcaataattcaattaatgtttatgagatttgattgaagacaaatccatcacggcaatctgtgaatgctttgttgtaaataaaaggtaatccttgtaataagcaaaaacaaattaacataacaaatgtcaatttacagatagacaaaaagtgattgttttctgaatgaaaagaggattattaacagttggcataagaaatcaaaaattagttcaacaattagtcatatggaaatgtcaaatattgacaatgtgataaagaaaacaagagtttctgcaaataacctcccatccctgatgtgagtctttcacgtcattctatagttcaactagttcttaataactcaaaaacaggaaagataaaatccatcattttgttttactacccagatccctcccgtagctgtcacacagagtgtgatttatgacttgtaagttgtgctatggagcttgacaagtaagtttgatttcatttaatattttctttaaaccatcttagatcttctctttgacaagtatttcatctattagtgttctcaaaatgtaaaatgggtaacttaatgagaacaaaaattgtacccaaagatatatttgcactatctacatatttgcaattaaatcttaacagatttaattgtaatagaatctaatggttttcctcttgaatttctttagacaccagaaatttttattactaataaataatgtttagcttcctagtcacaaaccaaacagaaagcaaatttcatcagagtttagaatggttaaaaccaacatagctgcaatatttttagttttgctttaaaattttgtttaatcaaacagtaaatcaatcagagttgatcattatgtaatccacagaccttgaaataacagagatatatttctccgcagatcaatatctatatatgtttttaagataagtagaaattcccctgaagatcataaagaaaaagtatgtcatataatatagttaaaaaaatagttattaattttttctgcttatgatgttccagaatctgtactaagcattttagaggattattttatttagttcccacaataatcccttgagaaatatactacaataatcatctttaattcacagttattgaaaatgagacacaaagaggttaagaattttgtccaaggtcaggcagctagcatgacttagcaagggtgtaattaagaaaaaatatgtttttcttatcttatgggaaatttggaaaagcaaatatctacattctctttttaataaaaaaaataaaatataaaatgtgagtctctcttaaagcagggaatcaactttaattaaattgaaacaatacataatcctttgttgttcaggttctgtattattattatctctgctgacagcaaaagctaagaatagaaaatatttctgacccaagttggcaaattatgaatcaacctgctaaagaatcagaataaactaacaagtggaattaaatatgattattctatattatatgtataatataaaaatttcttattgttataattttactaagattctaccagtttcaactaaattatcttttaaatccaagcttaataaaagaaattggcatgagatgttttcataggaaatagtgacaattcatattatttttaattaagtgcaaatgagatacattatttctgtatttcattttccttctaaaagtcatctttaaagttttagtttttctgaagttgacagctattactaactcttttgggccaagttttttgagatagattaatttataaaattaggaagaaactaaagtagttgcaaaagtttctaaaaagataataaagtagttgtctctatgttataatagaaaatgagaatgtgaatgcagatcattttgactgtttgtgttttcagcaaatattacctgaatattgatatataaattagaattccccaaaggaaaacattttaaaatgttaaaattaataaaatcattaacttacatacttgtccttagtatcaggacaatctccagtggattcaacagagcatctgcagttttgttgaacaaaggtttctgcaatatagacttatggtgtgagcttactgggtcacattctttgttccttcttggagctttgggaggcttttataaaagagctgctgcagtagaaggactgagttgtgtcacactgaggatttaagtttctatgggagaatcaaattcactttagtatagggatttagtgggtttccctagccttattaataaaatactaatacgacattaaaaatgcatactttgtcttacaataatccaattaagacactatttttgcatagcaaaattctttactaaacaccagttgcaaatcaagtgaaattgcattggcaagaggtgatcatactgctctcctactcctgccctttcctcctactccagctgaaaatacttggtgcaaatgtccttttataggagactttgaccccagggtatagaaaaggaaaggaaaaggtcacatatatatatgtcttgtctataactgaaacctaataccagcacaaaagcctaaaaggaccgatttttagagggcgttggcaggaaactctttgctctgctatcatctgttttaagctacttttatacatgatttattttttcagcttctactctgctactattcaactgcaaatgcaatttgttatattgtacacttcaacaccttgaacagcatcctaattattattgaaatgtattacgagttcgtaaagaaaacagcattttgtttcttcagtcatctacttaggatgaaagtgttatttagaaaacaataaatgggaaaaatgatacattaaaaataaaaattgctattaactttttagatcaaataaaccaattttaagcattttcatggacctttataaccaaaataaacatttaaatacagataatttaattcagtattttgtttcttgaaaatattggaatatgtgttttagataatgcatatatttctgttattgaaaaataagctttcaatagtcagctgacttcatacgtaaataataataccattttaaatttattcaaggatttaggtgttcttaaatatgactttataacttattttactcccttaaagtaaatatttatggcatctgtaagtcattgtaaaattgtaaaattggtatagcatagtattcagattgtcctttgtaatgttttatactattcacatttgtatttaatcacaaatttgatacaatttagccaaaccttcaacacatttatgaagagagcactaccgagactttatacaatggaataaaataacaaaatgtgctgacagcattcttccactcaaagaggtatatatatattttttattctaattctttaattttattttttagcacccaatgatagggaaaattactggaagtgtgattaaggctattataagatacataaactgtatggcataagcattctcaactcaacttcacactctacatcgttttatcaacttagtatgccagctttttaagtttggtggaatctggtattccacacctacatgtctctgaatcccatccgtgtactgatgccaagatgaactgaaccagggatgaatttttctcttatatggaaacatgaatatattccaaactggagtgagctctcatcagcggtttgcctatggtaattactttgtgccttgtaatgggtcatgtagtatcctcataagggtgcgtctgagtcctagaccctctcccattccagtacctgtaaatatcaccttattttgaaataggagctttacagatataataaagatctcagggtgagatcatcctgaatttagagtgagtcatgggtatttgggacacagaaacacaagcaaggtcatgtgaagatagagactaaggttggagttatgctgtcacaagccaaggagtgccaggagccaacagaatctagaagaggcaaggaaggattcttccctagagccgtcagagggtgtatggctctgcctccaccttgattttggtcttctggcctctataattgagaattttttttctttttttactattttaagccacaaattttgtagcaatttcttttggcagcactaggaaactagttaatacctctattgtttggttaaacaaagaacactattaagtatttttaaaacaatgtacatcagtgttgattatggtaagcatacagtttataatcagataggtttctgtgtaaaatttcatgttattatattgatttgttttaaccatacaagacttgcttggatgtggtaccattgaataccatccccattccctcctgtcccacagctttttgaaatgtatggggctttgttctagactgaacattccttttccctcaaatttcatatgttaaagccctaccccacaatgtgacagtattgggaagtgaggcctttgagaattaattaggtttagacaaagtcatgagcatagggccctcatcaacggaattagtgtccttataagaacaggaagagagtctatagagtgctctctctctctctctttctctctctatctgctatgtgaggatacagcaagcccggaagaggaccctcaccaggaaacaaatttgctagcaccttaatcttgcactttccagcttctacaattgtgagaaatgtctgttgtgtaagcaattcagtccatgatattttgttatagaagcctggactgactgataaaggctggaacatgctggagagatggtacaaaaactaattttagaaaaatattttaagttgtaagatctgaagcaaaaatcccttacatattaccatttacatcaccaaattactccatttacagtatcaaattaaggaaatttatgttttattcaagccttttaaaatcagcacacccaccttgcagaagtaattaataacccatgattattaattatgttggccaagttaattttcatccagtattacttgcagggaaagtttgaaattgatgaatcatctcccttttgagatgtcacttgtagaactaaaggctacctataatttctgtaattgttactctttaatggaactttaaacttctaagaaaaatatttcaatatattgttaaattgacttcaatgactaagattgtggtggagaggatatttccccaaactaactctttctctgacacttaggggttcattgtaatagtaacaccttgctagcaatcatctgctagtgatttgctcatggaagaagaaggctaaggaaatttaggtttgatgacctttttcagagtttctgggaaagcaaaaccttctctctactactcactgcaaacaagcatgttgtgcaagctactgctgccaaccaggtcacatccattagtgaagtcaatgctgtggagagagacattcaaacctgggtcactgatagtatcattttcaatttctgacccaatcaattctggggcttccaattcctctctccatggtcttatgtgaaataatacattttttaaactgttgaagtcatattgagctgaaatttcccttaattacaactcttaatattttaactatttatgctaagtttctttgttccagaaaaagtactttaactcggccgggcgcggtggctcacgcctgcaagcctgtaatctcagcactttgggaagccgagacgagcggatcacgaggtcaggagatcgagaccatcctggctaacacggtgaaaccgcgtctctactaaaaaaaaaaaaaattagctgggcgcggtggcgggtgcctgtagtcccagctactccggaggctgaggcaggagaatggagtgaacccaggaggcggagcttgcagtgagccgagatcgcgccattgcactccagcctgagcgacagagcgagactgttcaaaaaaaaaaaaaaaaagtactttaactcattttcatttttgtaggacttgaattttttagggcagtttcagtttcacagaaaaattaagaggaagacatagagatttaccatatatatgtagtaatatatattatatatggtaatataccatatattactatatatatatatatatatatatatataacaagcatgtggaggcagggtatattatatatatacacacacacacacacacacacacacaccctgacataatatatatatatatatacacacacacacacacacacaacccctgacataatgtgtatatataatatatgttatatattatattatatatgtaacatatcctgcctccacatgcatggcctccttcattatcaatatcttcctccagagtggtacgactgttaaaattgcctcgcctacactaatacaattttattgcccagtggtaaatatacataacataaaaggtaccatttaatcattttcaattctaaaactcagtgatattgaatacattcacaatgttgtataattaacactgttttcataacttttctatcacatcaaacagaagttctgtaccattaagcactaattctccattccccttgccccagcctccatgccctggaaacatgcaatctgcattcccactgcatgaatttgactattcatgatctttcatataagtagaatcatatactgtttgtccttttgtgtctggcttattttatttagcataatattttcaaggtttacccatgttgtaaacatgtatcagaacatcattccctttttatggctaaataatcttcccttgtatgtacatgccacattttgtttatctacacatacaggtttgttttcactttttgactcttgtgaataagaatgagtgatggtatctggtgtgtgcatacagccattttcttactaaaggccaacagcatcaagcagtctactaatggttgttatttatctgattaggatccagagttccaaaaaggttaattcttattttttccagtttaatggcagtttttgtggagggattgacttctataacttcctattccaatcttctaaaatccactttaaaagaatggtttaaattgtgtgcttgtaagatgaaattgataaacaattattttaataactttcaaaattacatcatagagataatgtcctttgactattgggtgttcatatatttggcatgttatgaacaaccttctggaagataaaggccttttatctcatacttaatattaagacaggaaccagtgtgctagcaatggcttttgggtttgatgtgatatatttgcatgtaatgattttttaaaacttagagagaaaaatcctctcatacaaaacaaaatagtttttactgttatgagaaagtagttattaattacttataaaacatgcaagtatctttatgatatttggtgacttatttttctccagccatcttgtcttgttgttagtggggaaaaaaatggggatgctctttatctatgaaaatgtgaaaagtatatacacattttaactatacatggtttccctaaaaattcttcttctgtttttaatcctctaaaatgatcattgatatgtacaaataaatattgatgatagcaactgaaggatcatttttgctgttatcagaaattgaaaatactgtaacagtctatcaatagagaaatggttatgtacattatgatacatagcatatgtccatatttagaatacgtaccaaatgtatacaacaaagtacaatgaatacatgattatactaagatggataggcatggatccacatattactctgtttgtacatggtcttttccaaacagaaatacaatgtaagaaagaagaaaagaaaaataaagagaaagagaataaaggcgacaaaataaaatataaaccaggatgcataagctggtctcaccttagggctggaacaccagtaaagcttctcttctctggaaaaagcttaggtctctgaagttttctcagtgcatcaaaactgacagcagcaggaatatggttttgctaaaggcaacagaagagcaaaacagtctcaagatttaaatattaatccaaaggttaaactttttaccttaatgttgctactttctgtatgcacatcccacaggatgtaggaaggtggaaaggatgaaggaatgtggaaaatgtagaaaattagaaaataaggtaaatttaaaaggtaatacgactaacattcattcattcacattaagctcctaccttgtaccacattctattgtagacactgcggatatagcagtgaaaaaaagaaaataaagaaaaatatgcctttttggagcttacattctcttggaaggagatgtgtaacaacataaataattaaactatataatatgttaagtgttgctaagtgctatggaggaaagtaaagcagacaaagcaaataaagaacatgaggaggagatataattttaagtagggaaataaggaaggcatgacggagacagtagcatttgagtgaaagacttgaagaaggtgatatggtttgactgggtcccccactaaatctaaagcttgaatggtagttcccataatccccacatatcatgggagggacctggtgggagacaattgaatcatgggggcagttacccccacgctgctgttcttgtgatatgaatgaattctcatgttctctgagggttttatcagggttttttcccccattttgcttggcacttctccttgctgccaccacgtgaagaaggatgtgttgcttccccttccaccatggttgtaagtttcctgaggtctcaccagctgtgcagaactgtgactcaattaaatctctttcctttataaattacccagtctaggatatatttttattaacagcatgagaaggaactaatccaggagataaggaaacaattcagggaggaatttgaagacaggtgttttcagtcagagaaaccatgtacaaagtatctaatatgagagtgctatggtctgaatgttgacaacccccccccccattactgttgaaatgtaattcacagtatgatactattaaaagttaaggtctttggaaggtgattatgtcatgaatacagagccttcatgaaggagattggtgcctttataaaggatgcctgagggggctggtttgtcccttccaccatatgacgactccaccatgtgaagaagaagatgggtctatgaactaggaaatagggcctcatcatatatggaatatgtgagcactttgatctgggacttagcttccagaactgtgaaaaataaatttctgtcatttataagctacttagtctatggtattttgttatagctgctcgaatgggctaacacagagacaattcccagcctgcccaaatagcaccaggaagtgttgggtacagcaaacctggaacagaggcatgaggggaagagcaacagggctgtgatcaaagaggtgtgcctggtggggagcatgagtagagctatataatctgtacaataatgactcagagtggaattagaagtccttaaaagtgagtgagcagagtggcatgatctccatgatactatgttatattcttgcttgggtattgagaaaagactgaaggtgagggctaatgcagaagcaggaagggggataaaaattcagatgagacatgattttggcttggcctgggtggataacagcagtagtaaaaattatttaaatgttttgaaggtgggtttgctgagaagtaaaggatgtgtggagaaaactggattgagaattgtataaggactgtattgtatattgtatgagagtgtagatccaggatgagtcacagtatttttgaagttgtagtaaatggaatgaactagaaagatagaagttaatgttcagaaggcaggagacttaaaagttagattgtaaaaatttgcaattaggagtaataacgtggtttgagctgagatcatgagattgaatagctagatactgaagatagcaagtacattggaaatgacgaggtcaaatgtcaaagaagataagtaatttaaatgagacatcaaaataatggcagtaagtcaggttgtaaagacttcaaagaatgagggaaagtgactaaacattgggagagtgatcaatataatcaaatggtatgagattccaagctggaggggtttgaggagaaggaagtagaagtattctgcaagaggacacttattttacttctagaggcagtggttagagcgctgagggtgagaactagtctgcacttagggggagacatgagaagcagcagcatcagtgagagacagatgacaataagaatgaaaatgtaaagggaaaattgagaaacttataaaaattgagattcttctatgcactctgtacgtttcttacagaagctttcaacgcatttaatttcatttaaatcttgcaatactcttgagagatattatcattccctttttaccaaaaaaaggctgaatggccaagatcacataaaatcacataagtaatagaagtcaaaagtatgactttaacccatctagtgttataagaaccacataatcttcaataagttgaaagtatcttaattaaattaaaaaaattaataaaatttttttcaaaagatgtattcaagttatcaatgtgaagaaaaatgaacatattacttagaaacagccctggattagagtcccaattatatcacttaataattgtgtggtttaggtaagccatgtaaagttgctgtactacttaaatttaaaataaagacaattttacctaaacataaaattgttgtaatgttattgtgcagttataaatcacttattaaattataaatttatgataagtattaaacagaatacttaattttaagccataaggtcttctattagaaaaatactctaatataatgtgatacatcactcatttttataaatataaatttaattatagccttaataaaaaattttggaggtgcattaccaaggctaaatttatatttcataaaatgaacaaatttaagatgtgtaccttaactttatgtatttctgcactcatattcacaccagccatatcaagataaagaagtttcactaccacagaaaatgttgtgctgctttattccagtcgataaccactggtcaaatttgtctggaatcatatagattttatgcttttgtgtctgacctattttactcaacatgatattttggagatttatctatgctgttttatgtgtcaatattttattttgtattgctatgtattattactctgtaagtcaatatcataatttatctcttctccactttatagatgttacatccagtttttgcctacaaaaaaaacctgctgtgaataattttatatcggtctctattgtgtgaatacacaccctcatttatttttggtacatacctataaattgaatcacgatgtcactgggtatgtgtgcaggttaactttataagaaattgccaaacttctttaaaatatagctgtaaatttactctcccaccacaaatgtatgagattttctttgcttcataacctcttcaacacttgctatattcagtccccaattttctttcttaagagatggagtcttgctctatcacacaggctggagtagagtggcacaatcatagctcactgcagccttggactcctgggctcgagctatcctcccatatcggtctccaggtatttagccattttaattttaccagttctcttggatatgtaatgacatctcactgaggtttttattttcattttttctgatgaccaactatgtcatcaggagtgaaatcactgagtcataaagtcattgcctgttaaactgtttgtttgctttttaaagaaagtatcaaattgttagagaatggctttgttattttacattcccatcaaccgtgcagcagttaagtagtttctttgcagccttgctagcactcagtgttgtcattattttttattgtaactattccattgggtatatattgaaatcccattggggttttaatttttcattccctaatggctaatgatgttgacgtcttttcatgctctgattttccaaacatatattcttttcagtgaaatgtatattcatgtcttttgcccactttctaatttgactttgttcactcttaagttttgaaagttctttatatattcttgctactagtctttttcagacacatggcaagcaaaaggggaaggaaggagcacctttttactgtcaagttgagatgaaggtcaaggttccccattaggcctcctttgccacacaaaaagtaaatactctgtgtttttaagataaagtaatggatgccaagaaagactcaaattttttttatgtactaatcataaaaatgaactatgatttataattcttctcgtccattttcattatacataagttaagaaaacaaaatacatcatactcaataataagaattctgagtagaaactcaccagttcaccttagctatattttcccttttgggtttcttttacttttttttctctctctcctttttctttaaaaattttggagtgtgcagagggataagggtgagggagcgtggcaaggagaggagttcagatcaggacagggaatggaggagggcaaggagtgaagggcacaacccacagcctgggaaagagaggcatgaaacccagcgtgtcaggtggacggatcatggaatggggggccagcggaggttaaggaaggagggcccaaaggtaggggtgggaaaaagagaagaggaggaggaggaagtgcgcgtgtgaagagtgttaagaaaacgacaggacagagcggggaggggaaaagcgggccgagggacagggtgaaaggtgagaaaggagggtatgaggaaagagggtccggggcgctggggatttggggagacgatggagcgacgggtagagcagcttgggccgagccgcgggggtggaatccagacgccgggcgggggagggggcggcggggcggcgggacggtgggtgggggccaccaggcggcgccggagaccaccaaacattacagcgagcgagcctgcttcctggagggagtgcagacaaggaccaggagcgggagccgagcctcgcggcccggggcacggcgccgcccgcccctccccggcagtgcctcccgaccccctgccctccgctgggacatggcctgaggccccgcccgccgcccgggacccctcccccacgctgcccccggaccctcgccccaggaccgcggggtctcttcccggccccgccgcccgccccggcgagaacaggcccggcgggcaaggcggcggcggaccgagggaggcctggcccggcagcggggagaagggtgcggcgcagcccgagtttcccaccttttctcctggcccagacgcggctggggcggacgggatctctcgcgctctgcctcctcctcttgcttcatggagccatgcgcctgggtggaggctcccgagagaagctggcctgcgggcgggccggacgagctgcgcggacggggcggggcgaaggaggccggcaggcggaggaggaagcggcggggcggaggcggcggcggccgggaagaactagaggtattccccgggcggctggaggactgagtcgagccgggacccgagtcctccggtatcccagcagccaccggaggcagtgagataatggaggaagaatgtagggagacctccagtggaccgcactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagacatcgggggaaagccgcgagaaggccagcgtccctggctgggagcagagctagccgagtagggcgcccggctgtcaaactggccggcgcagtgcacgctgggccgccccggagcggtcgcagagcccgtcgggagtcgtagtccgggacgggcccgcggcattgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctgaccggccgcagccttggataccagccttaaatcgagccgactacggcccagccccgcccgcggcgaggtgcgcggggttcggtgccagccgctcgcccctggcggggccagcctcttgatgcaccggggacgggcgcccccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaaattttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctagagcaatgtctttcttgtattaaaatacggccccatgctcacaaaaaaaaaaaaaaaaaattttggagtgtaaacatatacatcatcttaatttgagtccttatgtgttgacggtgtgcagggaagaatgggaaagtaactgtaagtggagctcagaaagaactaacaaattcatgaaaaagtgacattattgctggtctatttttttttttaaattttctgcttcctcacactctcccatactaaatgaattatttagtgggtttttttttttgttttttttttttttgtgatacggagttttgctattgttgcccaggctggcacgatcttggctcaccgcaacctccgcctcccaagttcaagtgattctcctacctcagcctcccaagtagctgggattacaggcatgcacccccgcgcccggctaattttttctgtttttattagagacggggtttctccatggtggtcaggctggtctcaaactcccgaccttaggtgatacgcccacctcggcctcccaaagtgctgggattacaggcgtgagccaccgtgcccggccgacaggtgttttttatgagttacagactatgtgctttcagaatgaggcaaccgatttaaggatgtaagcataatttaaggatattgaaaatgatataggaataaattttgtttagtcattcatggatttattcattttcagatgactatgtgtgtgaatatttaagaattctaaaaccgcatgggattacttataactatataggagcctaacacgataatggaatcagaatatactttgctgaagggaggaggcttttaactgaaagtcttctctctacgtttttatgtctctaacaggaatccactgaagacctacatttcccggaaggttaacagcccccttctcagttttcctggtaaagtgtttttatattggtagaataccttctgtcacactctatatttttcttatctcaagtagaaaaaaattttgcccttttgcttgggactgttaacagccctggtagtggaaagtagaaggaaatgattctgtgaattttctgttatataaattttagccagtttaggacttttgaatgaggggccatacagccaaggatttaggatttcagctcaggaaagaaaactgcataggtgtttaattgtgtcctagccacttattagctgggtaactttgagcaagttttatacatatccttcccatgagtttttcatttctaatactggctgtgtaatacagtatgtttcatagacttgctgtaataatcgatggagtgtatctaatagtgtttattttactgtaactgggccacagttaggaagtactcaattaaaattagccgtcattattcctagtattaatatggtgatgaacagctaaagagcatttaaataattatcattaatatggataaattttgaccatacctgaataaatatttataatataactgttgagagtatacaagtttaatattttagggaaatacaatgtcaaattctatcaagctctattttcaaactaaaacaatagcagtttgctttcagatattttgaatattattgtgacatttcccccttctacctttctgggaccttggatacaggaaccatgtaagggtaaatcgtttaggtcttcgttgtgggacaggggtgatatactacagttccacaggggctgagccaggtttcaagggtgagatagagagctgatggtaaaaataacaatgagagcaaaggccaaaatgtatggagtatttattatgtgtcagacatttttcactaagcattctagtacaatatttcttcagatctatgaagatcttaatcttaagtagtaaatggttttattataaccactatacaaaatagaaacactaacataaaaaggttaaataatctgtttaaattatcttggattatcaacccaattagctgtgtcctcagaacagaagctggtagcactacactgaactataccacacttgcaagccttcagaggaaaattccctaagagaaaatggtatttatgactcaatatttcttcccataccctcagtgacttacgttatttatttactaaatgccaaagcagatagtccaataggaaatatgtagctaaatggcctgcgaagagaagggaatgtcaaataacaggcaaaatagaatctgacaccctaggtctcagcaagtgttttgaatggacaataaagaaagtgactagaatgtaacctctgaaaaaatgttgtgaagcaccaatggccttgaaaaaatctagggagctgatgtaaaggacatccacttcataatgacaattgttgaacaaattacttgttggagatggagttgcagacaaaacaaatatttaccactgctttaaaatacgtttattgtactcaggagaagagtctggaactgtggtttcagaatgagcttatccaacagtaagaagaggactggggcataccttttaaaataataatgatatatttataatcatcctagtgtgatttatttaccttttagtaaatcaagttctcagaaaactaaagtaaaaaaatcttaacattacatatgcaggacttaatctgaataatcataaattttcataaacttaatttacataccacaccatagtagctgtgatatagtaaattaataagttttttgtactatggtgtaactctttcatcctaagaataaaaaagattctattatgtcaaaagacatgtatctggatggttaaaaaaatccaatcatacataactgaagaaaatgtaggtattttagtggaataagaatgtgatatatgaaaacagaaaaataaatatcttcaatgttacttaaagaaacagaattaacaaagatgtatcatggaagagaggatagttctgtaaaaacacataaaataactttcaaagatgaaaattttacatatgtaaaagcatttgtcaatgaaagtaataataattccattcatgcatttgttcatgtataaccaataacttacttgtgatgccatagaaaaaattcaagcatcaaactgaaaagcagattttaataggtaagaaactagtggcctttaagctgacaatatatttgtttgaataaaaaatattattattttaaaataatcaaattagcaaaatacaaaaaaaaacatttcacatgaatatcttaatttttggtatgtgtttaaatatcaggacatttactcatattcttcataaacagagtcataagtcttagtagatgctgccatgtgtaggcgggttgtcttctctaattatcctcagtccccaccattccatagtgtccccaagtagggatattactgacatttttcatttattgccataatttagctgttgtttttcacagtcagcttgccttctttattttaatatttgtataccacataggcatctcagtgtttcactcttgctatgagacagccatagatctcttttgacctagagttttttattctctttgtttttcaaaattattttccctaaaagaatggaacctatgagcctccaaatcgtgcatttaaactcaatcacctctagaaaacaatggtaaactattcagaaagaatgaagagaataagtgaattctccaaacccagagctaatgagtgccagctctgaaaatgaagtccttgattcttgacatctggcctagtgtgcctaggaagtataatcagttactctgactcagtcattttaataattgaagtaaactacttaacagttaaacattatatacttaaaatacttaaattagcttagatataatcgaagaatttcactttttaactccaaataatgaagtgtttggttgtagggtattagatctttcatggaagaaagtagtcccgtaagtctaagtacaaatttcaaatgtaaaataaaactgatcaagccagagaccaggtttggcaaaaagtatcatttgatatgacttgtaaaatgtcaattattgtgaacaattttaaaaagacctcatcagaccatattgcatgttctcataaaggggaaaagaagtatataacagcatgtactgaatactgtatacccattatacatcgggctttttagattcattctaccatttaatttttatggacatgctggggatacggtattgttatcatccttattctttagtgagaactgagatttacaaaagaataagtaaattttccaaaattaattactgataatgtgtacacagaccatttccaaattcatgagataattgctgttttagttactttgggctgttaaaacaaattaccgtagactgggtgacttaatcagaaaacgcgtgttctcacagttctggaggctggaaaatttaagacaaaggtgcttgcacatccagtgactgatgagggcctgtttctttgtttgcacatggccattttctcattgtatactgacatggcagagactgagagagagaaagagattatctctttgatgtctcttcctgtaagagtattaatctcattcaccaactaattacttcccaagggcccaccactgaatactatcacactggggactagggtttcaccatacgaattttgaaggcacatagacattcagttttagcaactgctaacaatattactcttacacaaccatttttctcacttaaatattttcaatcaattatttaataaatggaagcagtgggattaccttggtatgaccataagaatttatctgggagatgtctatgtgtgtgtgcatgtgtgtgtgtatgtttatcgtggggaagaagtttgtgagtagaagcagtggattgagaatctggataagaaaatattctattgatcctggtgatttgaatgtacgataggagctggttgtcaactgatttaatcagtgggtatttcagtatgaggcatagttggtgactgagctttcatgtggtaatctgaggtgaatattgacatagaattagaattataactcacataaattcacacaaaaacatttttacattgcctactgatttttatacatataaccaagaaataaagtatatggtggccacctttctccagggatttatagggtaattagatgaactcttccaataattataaaaataagaactgaaataacaagtgcatattctgaattacaaaaatcattcaaagtaacaaaaagcttatatctttgatcccaataacctattttaattttctttttaaaataaaagtgttagaggcaaaaaaaaagccataactaaaccaagtacagataaaggaaataagaatgagaaacagtgtatgtgtgtgtgtatgtgtgggcatgcctataggtatagttgtgtgtgaatttaagtgaacacacttactaattgaataaaatacagtaagtgtttgtatatgtatctgcatgtttgtgtcgtattttggagttgttattcagcttttacagaatattcaaatagaaaaccaaataagattgtcacctatattgcataaataaccagagaaaagtcacttaagtggccataaaagaaatgttgaacataaatgcagagaattctatttagagtaagaatgcccacatgtattacagtccccaaaaagcaattaagcagaagaaattgctttcagagcttggaaagatttaaagtgttaccattaaagtttgagttggatgttactccatgaagagaatatatccttaaacactgctgccctgtgcatcagaacatactcactccgatattggacctgttgctggttagaaatgtcttgacaaatgggatctaattaaactaaagagcttctgcacagcaaaagaaactaccgtcagagtgaacaggcaacctacagaacgggaaaaaaattttgcaatctatccatctgacaaaggactaatatccagagtttacaaagaatttaaacaaattcacaagagaaaaacaaccccatcaaaaagtgggtgaggccgggcgcggtggctcacgcctgtaatcccagcactttgggaggccgagacgggcagatcacgaggtcaggagatcgagaccatcctggctaacacggtgaaaccccgtctctactaaaaatacaaaaattagccgggcatggtgcgcacgcctgtagtcccagctacacgggaggctgcggcaggagaatggcgtgaacccgggaggcggagcttgcagtgagtcgagatcgcgccactgcactccagcctgggcgacagagcgaaactccgtctcaaaaaaaaaaaaaaaaaaaaagtgggtgaaggaaatgaacagacacttttcaaaagaaggcatttatgtggccaaaaacgtgaaaaaaagctcatcattacagaaatggtcattacagaaatgcaaatcaaaaccacaatgagataccatctcaggccagttagaatggcaatcattaaaaactcaggaaacaacagatgccaggatgtgaagaaacaggaacacttttacactgttggtgggagtgtaaattagttcagccattgtggaagacagtgtggtgattcctcaaggatctagaactagaaataccatttgacccagtaatcccattactgggtatatacccaaaggattataaatcattcttctataaagacatatgcacatgtatgtttattgcagcactatttacaatagcaaagacttggaaccaacccaaatgcccattaatgatagactggataaagaaaatgtggcacacatacaccacggaatactatgcagccataaaaaagaatgagttcatgttctttgcagggatgtggatgaagctggaaaccatcattatcagcaaactaacacaggaacagaaaaccaaacaccacatgttctcactcagaagtgggagttgaacaatgacatgtgggcacatggagggaaacatcacacactggggcctgtcacggggtggggggcaaggggagggatagcattaagagaaatacgtaatgcagatgacaggttgatgggcagcaaaccatcatggcacatgtatacctatgtaagaagcctgcatcttctacacatgtataacttaagtatcataaaaagaaagaaatgttttcattaataatatttctcaccttttctagatataaatttaattcacagttgggcagggcatggtgcctcacacctataatccgagcactttgggagcccgaggcacgcggatcacctgaggttaggagttcaagaccagcctgggcaacatggtgaaaccccgtctctactaaaaatacaaaaattactactcgggaggctgaggtaggagagtcgcttgaacccgggagacagaggtttcagtgagcccagatcgcgccaccatactccagcctgggcaacagagcgatgctccatcttaaaaaaaaaaaaaatcaaaataaaatacaataaaaaataaaaataaaatttaattcacagttgtaaccagcctaaattaaaaatatttcttaagaaaaagattgagactttatgttttagatagttgtgtttttatgacagaatacctacacacacacacacacacacacacacacacacacacacacagacaaactaaagaactttttctgttatatatcaaatcatacttttgttagtgtgtttaattttattttatctttctgtgtgtttctctcatcaatttatctattatctgtctcttaatcaatccatccattcatccttccattcaatcttctattacttttaatatttttaaataaactgccttgttgctgtgatttgtattaatgtagactggcagagcctgaaatgacagaaagacttttatttgcatggaatctcctggaatcagctaataattcactatggactctatttactcagattaataactgtgcagaaatgtcattacctgaagagcacaaatctggggacagacagaattttaatcatgggctctgtcatgactgattggtgattttggttgcttaaataatccagactctagtctcctcaattataaaacagggaataataatggactttattatatgttaagcaacataaattgctttgggtattcaaagaagataattaattgccgtggattaggaatctgaaatagaagcttgaattcccaggagtgaaacaaatttagcaatatttgcatgactattggagaaccaggccacttaacaggtatacgtatgcccctctgactacctcctagatattttctgccacgtcagcagtaggcagaggaccagttggcttagtgtctatattgtttacatgtggcagctcaaacaatgtgatatgaatatgaactaaggagggagacacttcacacttaacatctgttcttcagtttccccaacaggatgcctccaaatgtgaaaggaaactcatcaataacaagctgagaaatgagtctaaacaactgacattttggaataacatatttgacatttgtgaggtccactggttgtggcttaatcaagaaagccatcagatatccacagtatccatcttttaggcatacacatctaaaaaacacatccatttgtcttattttaaatccatattttaacgttcaaaatattatttcatggatattttgccacacgattatgctagtttttactattttctcccctagtgtgtaaaagtacaagagaatacaaattccttggcaagtcagttatttagtcatttcaaattttgatatttccagaagtcatgaggattcttctctcacagatgtgattataaaacacatttgatttaccaacttttagacttctgttttctacaaattagctctcttgcgcaagtggagaaatagcatatgtatttggtactaagtttccctcataattgtcagaacctcaccatttattgttttgtagaaactgggatttaaaaaaaattagaccatatgataattttgatattaatactcttctgaaagactaagtgaatgaactagtcatctatattcactgattaaaaacaaaataagacaaacttattccatagtactttgggtttgtctaaaaaaatattcgtttataaatactatttctgagggacaatagcatttctctaggatacatctatgtacatgcaactgaagaaaatagcttttaaatttactttatctcttgtagtagttttatagctacataagagtattgtaatgcaaaaggtacatcataaaaactgctttgttatatgttgtgtgcatttgtatttgtgtatttacatatcgacaacgtactcactattgttcagtagcatattttatgatgaatgatgaaaccagtacaaattacatgtgaatttgacttatgaactcttcacatccactacctcataaacactacaagctagagaatgtagggacttgaatccacaaaccacagatgtcaagattaatctattacgttttgagtacttgaaactgcctgtacaattgaatttatagctgttttttaaaaaagaaaatagaaatgagaagtgctacagcaatcatactttgtgatttaaaagaaaataaatactattagttcatgcccagaaaaacaaaaacaaaaaactatgggaactttattacccttatctatactctcccacctgcaagaaaaaatgcctctcctcacaatgaataacactaggtagaggaaatatttctgcttagttttagaaggaagagaaaaaaaatttttgaaacattcatcggtaaataagaatctgaaggaaaaggcaatgtggaggaggatagggcatgacttcactgctgggagggagatgtagcctggcaggctcacagcgactttttcatagtcagagccacctacccaaaggtagaaaccaaagcaagtataaatcagaaaaataatcctcagtatattacatttaatgtcaaaacatactttgtagaatatgtgaactgcagtcttattttgagagctaatctagaattatgattatatttggaagcctgattctgtttgcctcatttggtccatttggttgtacattaaggcttgaacataaggtttgtgatataaagctgtctttaaataggctccatgacatttaaagttatctgctgggaaataatcaactttttcaaattcataatagccttgctttggggaaattagttttgatttgatgagcaaatggatcactgagatggggagtagtgatgggaagcagtcatagaaaccactagttaacacatgtcacggctaataatatcaggtattttgatgctagtgtcaatgggatccagcatgccagttaatttcaaagaaaataaacaacaacaaacactttgattgtgttatacaacctgcagtcattattttctattagctgttatctacctgtttatccattgattgattcatcagtgtgtgtatgtgtgtgtgtgcatttcagaatggaatgagtgatgaaaattatattctttcgtgcatagatatttgtagagggcctgctgtgtgccagatattaagcaattgcaattgagtaaaatagtatttaaaaactactcacagccttcaaggagcacagcgtctaactagggaactcagacaagtaaataggcaattacagtgtaggatagttctggggatcagaaaacaaaacccccaaatgaaagcctcagctgcagcctcagaaacaaacatttttctctgaccttctccagtcctcttgtctcttagttctattctcccataaggctggccatggaaactagaatctctcttccacaacagtgggtcatagtagacagaacccctagaaccccttttctccaaagccagccataaaacctatggctttactgcattttttattatgtctttatttgtaaatcccacataagtaagcgattctcatggaagcttttcttgactttggccacactcttgcatccacaaccaacttgtgctaccaagtgaacaaactatgactaaaggcctgttcttccactttgcagctgctcctatcagtgacaaatcagcgtattagaacatgcatgctggctgatcattctgatcaagtcaacaagcttcacaacttactcaatgaggtcgtccgtgagaacttcactgttttacggggacaggagctacttctttgctgaactgcatcacggtttcaactgctgaggttttcttcaagcttttgcattgtttggaatgtgaagggcatggccgagacacactttgaggttcccactgcattgttacacctcccccctcacttcagggccaggtgagcaagggaaaggagcgtggcctgggcgtcccgcagggcccccactaggaaagctatgaacgctcccgccttgagcacagccacaggcctgctctggtcacaatgtggggtcgccccacggacactggtgaccagtgggagcatgaccaggaggtgattaccttctgatcacccttggctttatttttaggtaacaccaagaaggacgccatgagagcgaaggccgttgggtcaccgccctttgctctcgcgctgcgcgtctccctgccatcaaccgccgcaactggcgctgggagcggttgagggcggccggcctcgcgctggaacctcgcccgcctcaaggctcctgcggcggcacacggggcaggccaggacccgccctaggagggccccgctggagatgtggaaatggagggacgcggcacctgggcgcttcctggggccagacaacgccccctcattggaacctccatgaccctgcctctgagaaaccagcgcgtccgcaacgatcactcctaattttcggtaatacaaacctgcagtccatgcacttaggtaacacccttgctgaaaggtttacctttggagggtttatcctaaagcaaagtatcctcaaattgcatgtcttgcattccctttggatggcattgatttcattcctgctcatgcctttcaaaaaatagtatgccctgttttcctactcagtctggaggttccattaaagagtatttctggcaaagatttttagacctgaaaacacactccaaaatatattttcttctgactccattcccagagtttttcctaccgcattcaaatgatttctagaaatgtttttgttgtagccttgatcaatttcagtcgataaagcagcagatagtaagggaacaattccacgctccccacccctgactctgcaacacagtgcagaattccagttggcaataaaaaactagtagagaaggaactcactgacttcagtttgtaataccgtcagaagaaactttaatcgtcacatcctttctgctcatttgcaggattcctatcatctgtctccacgtgataacactgaagagccttcacattgatgcaggcccagggcctcaagtgcagagactgagagctctgcaggacacagcatggagccgccattcctctactgggtggaggagcatgtgtcctctgaacaggggatccaagccctgagatgttctttctcagctgtcagtgcggcccaggactttctgtggggatgctcagacagcgggccggaggacttttagccaccacctcccatggccagtcttcacaaattacccttggctaatttgactgtctctcctcctggggtctaggacttcaaacatgtacagaagcgattgcagaattaagacaagacacttccacaatatattttttgtatcactggctcagaaaaagactcattcaaatcctgtatcaaagccacgtgtgagaatcttgagaaagcatcagctgactgacttgacaagggaggaagcaaccaaaaattctgcgcttcttcagtatctgagtatgatattttgcttcaacatccctcttagatgaagttattgattgaaaatcatttaagtttgccccatggtaaaagatcaagtcctcagaaagatctccaaagtgtttacggtttgttttgttttggtaagtttaccatgattttgcttgaattgctctccgttgatcttctcagctaagatggaggtagagagttgcacagtggaagagggctgcatgtaagaaggcagttctgtctcagaggacaaaaggcctgggagcacccagacagacagtcactgcatggaggtcactcccctcccagtggccactgtggagacatttcacagaaatgcttgctggaccattcaggttcagagttgggacaaaaccgagaactcatggggatattggacaggagttaggaaatgaccttctcacacaactggggcagtgggggagaaccctgggcttgagacttgcaatccaccacttgcccctgcccctgcccctgcagtgtggccgctgttaccttttcctgcaactctgccttcttgagtccaaatgtcttcgaaaggggcaaatgctcgtaagtgccgacagggtgtgtttcagtgaatgtttgcagtgtgcaccggtctggctgaaggcctcttcccttccccaacaccctcccatcgtgcaaaattaccctgcccagcagggagtgacttgtgtgtctcagaagattttgttgctgtgctctgagttctcactcctcatctcctttgaccagtttcttctaatactccccttgttcacaacacagaacatgagtgctctttcctatcattttgacactaataaacggacagtgattctcagtgtggaaatgagaatgaagttttttttaaagacaggctacaataattcccatgcagagaaccacatgcgatgacactggattccagacagcaagaacgtatggtgaagatgaggccaacagtgagctgagagaggccagccagggtgtgtttcagtgaagatgagaaacaatcagataacacctgtttcctccaggaaagaaaatgtggccagggaaaagagatgggaggaaggccggtcattgcctattccactgtgcacagtttgaatttggagccatgaaaagtattgcttggttaaattaaaatcattcaaaagataaaacataaatatttaacaccagcacaatatgctgggaaacaaaatgaaaggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagttgcctaaagaggcacacgccatctctgctgctgccttccagttggaagggaaactcaggttcttgcctaatggccgaagcccttcacagaatgtcccccacccctaacagctgcccactgcccctccccctctgcagaatgtctggggtcctatgttccaggaacctgtttactttcaaattttcctgtttcagttggactcaggagcatctggtgagccaggtcactctctgggtcttacccttggcttttctcattgtggaaactgccagacagcggtagtcagtgcccagcctgaggggatggcttcaaatggaggtaagcctgtagggatgggggcattatctgagtctgccatgcctcaactccttaggaattcaaatttgacactgccccggggacagttgatagggctgatgttgaggagggagggaagactggatgtccccaaggacatcacacctggggatggccatggcaccctgagtctgtgtttagggaggacggccccttagaggtggaacaagatgcctgggggaatacaccgtgtaggagaaaggacagagtggatggattgatcctttctagaaggagacaggtcacgtcattgtgtgtttgtagggagtggtgggatcatgttgtgctggtggccccgggaggatgataggcaagcctgaaccctgtgccatatcttcaggcacctggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtctgctagctcatggcctgtcctctgcactttgtgttactgtggagatgaagaatttgctcctattccatttatactacctcatgaacggggggcaggtgtggattcttgctggttctcagtggaagggtctggaaaggctggtttccttttcagtagaggaaggagagtagcgcacgaataggaagatggttctcttattattattattcaagttaggatacgtgtcctgaatgatgaggtgcatgtgctgtatcccttattccccttgactagagactgcatgaggtcctattgaacagggatgagttccagacaactttgcctcacccggcccatggcccaagaacccctggtttttggttggtcactatgttcagtcattgggagctcaaaggagaagggccagggatgggctccttgtcccactacctattgtaacatgaccagcagctgtgaaaatccctagacacctcccctgttagctctgctgctcgccatttgctggctgtgttctaatcgtgtgtggcttttgctggctatgcagtgacactgtctcaggggactccaccactgcctctcagacctgctccctgggaacagagcttcctgagtggcagccgggaccatcgagtactgcggaaagggtggcccgaatctgacccctatttagcacttgctgtgggtggtgccaggacaatcacttgcatgctgggcatgacagttatggattatcttcagggttcctagggcgctggcttgggaaagatttccatccagtggttttgttttgttatgtctgagctgggaaagaaaggggtttacaagagcgtcaggaaaaggaagattgaagaggagatggggccataatattcggaagcttctggcttcctgtcggccttctgagtgccgagcactgccctggggtaggcccctcacctgttgctgagcacgctgaggaccaccaagccgctgagagactcatccctgacccatggcttgggagatgcctgtgaggctgacagggtctgccagggacacccgagggagaccctcgggcagcgaaggcttggctgttacttcttgggagacaggggtcagggagtcttggtgaccggggccaggctctctagtggagcgactctccgtggaggaacagagcatccgatgcacactcagggacatttgcaagctgcagtttccctgtcatacgcccttagctgttgggactcccctctgattccccagtgactagtgtggacctggagaccccagctcattcacctctttcctttgtctccacagcatacccagcgctgggaccgggcgtgaccgcgaaccctggcacctccctgtctgtgttcacggctctgcccttcaccacacccgctcccggcccagcacacgggccgctccttgtgactgcaggggctcctccaggcggccctctggtgctgtctaacttccccagcacacctctggtgacagaacaggatggctgcggcccgagtggggccggggcttccaacgtctttgtccagatgaggacagaggtggggcctgtgaaggccgctcaggcgcagaccttggtcttaactcagacccccctcgtctggcaggctccaggcgccctctgcggaggtgttgtgtgtccacctcccctactcctggcagctgctcctgtggtgcctgttatggctgcccaggtggttgggggcacccaggcctgtgagggaggctggtcccagggccttcctcttccaccaccaccaccaccggctgcccagctgccccccattgtgtcccaagggaatgctgggccatggccacaaggggctcacggagagggcagcctggcttcctcccaggccaaggccccgccagatgactcctgtaaccccaggagtgtctatgagaacttccgactctggcagcactacaagcccctggcccggaggcaccttccccagagtcctgacaccgaagcgctttcgtgcttcctcatgtgagtgtcctgggggcattggagctggtcctgcagctcacacgtaaagaggctgctggatggacgggaggtcacgctgttcaggggagcttgcagggcggttgtgagggtgatgggctgcactatgggaaggtacattttcaacaatattaatctggctgcggctcaggacagactgtcaggggcctcatctcaactgcccgtcactgtctcgtgagtccagccaatccttactttcaataattttcacaacaatgtttacagaagacccaggtcagagagggttcctggtgtgacgtgagctacggtttgggtttaggtctttgagtacacaccccagtgcctcccctttaacccagtattgatggccaggagcacctcacatggggccgggggaaggagctgcagggcccagcaggaacctggcacatgcccgcagttccgctgaggtccagttagcacagcggtggtggagcctgcacagggggatggtcttgggtcctgcactggggccgatgccgggcaggtatttgcatcttcaccctcaatccctcctagaaaaagggacaatgatgcttcattcagaggatggtgaagagataacttgagctcacatatgacatgcatagcacagtgcctggcacatgctatgacacattacatgatagcagttatgattactgtccccattactatcattatcaagactaggccatctaggagagcactccccaaagccacgggctccagtgatagctctgagtgcaccatgagtccagcagcccagggccatggactgtggtgactgtgaggcagcaacgtcagcatctgggagagtttgtggtttcattcccagtccctgcctctctccaccctgcggtgcctctgtgaccctgtgtttcccgctgatgagcaaacgggagcttgagcacatccaccgtgcaacacactggccgttcccctagggaagtcccctgcctggggtgtaggtggaaggtggccccattttcatcccccaaaatctcgctgttcccgcaccctggaactggttgcattcctccttggagcggagtcccggtgcactggggaccctgattcttggggtggagctgccccaggctcacaggcctttgccatggctcctgtgggaatgtgggatctggacctgctgcttgcagtggcgtggacaccgctctgctttggttctggacgtgtgctcctgctcctcatgctccagggccctgaggctacgtccccaggggctgccttgctccagagtccccaggaagccggttaaatgctcagtcttggggccctggaacctgcactttaaccctcacccccaggtcattctgtgtgcacgctgtctcagtcagctcaggctctgccgtaacgaatgccgtagactgggtgctttatcaagacacattcatgtctcccagttccagaggccagaagtcccagatcaaggtgacagcagattgggtatctggtcagggccctcctcctggctggagagagctgtctctggctatgtctcctcgtggctgagagcaagagccctggcgtctccttctgcccttatcagggcttggattccatgactgggacccacgctcatgacctgctttaaccctgattgcctccaaatactgacacactggtgctgaggacttcagcacaggaatgttggagacacacatgttccacccatagtactgagtccacttctcaacactgaggactcgaggggcagtcggagaggccacttggtagcttgtgttgatgtttgatcttgggggtgtgtcctggggcctgaggagcccacatgggggagaacaggacagggacagatggcaggacaggtgtggggaggacaggggccaggtgttgggaccaggtgggcttgggatgaagggtgggcttatagactgagactgactgcactggtttacagcccagttctccgatccctggcccggcggaagcccaccatgaccctggaggagggactgtggcgggccatgcgggaatggcagcacacgagcaactttgaccggatgatcttctacgagatggcggaaaagtgagtctggggtcctgggagcggggcccgcgtggcagggtgagagtgaatgacagaggcccggtggccatggtggcttctcaacgtggagtatgaggagggtgtggagaaacccaggacactctgggcccctggctccctcaggaagctgctcctgccacctagagtgttctggggtctctgtcctggcctattgggaagcaccccctgcctggcctggggccatccctgccttgacactggaggtcatggcaggagcagccagcatcacagaccaaagtgggtcacctccagctgtggggatggggagaaggggcgctagtgactatggacaagagtagggtgcaggctcctcacagcagtggccagaagtcggttttctcccatcccagcctggccagggagttgggttggggagacctgcacctgggacaccatgggacccatctctggcctgactgcctttgctcctgggcagtcccctccatgaaggcagacagatagacagcagcctcaggggaaaggggccctgtcctctgagctcagcttttgcttcctcctgaccaggggtctcccaggcctcgtgcccctgggttatctttcaggggcccacagtcctagcctcaggactcctgcatctgggcatcatccctgatgccttctgccataaatcccacccctggccagctgaaacctggaggaggggtcccccgagaccctcctggacctcgtggccctgagttgagtcaggaagccccgttgatgccatgggctctgcaggggccgggtgagggagggtgagcccagaactctgggagcagctttctcctgggactgggggatgggacacagtgagggcctggacagcccacccgaggcactccctcccatccctgccctcggccgctgcctggtcctggggggagggggcctggaccctctcagcacagcctgggcctccttcaccgccaggttcctggagtttgaggctgaggaggagatgcagattcagaaatcgcaatggatgaaggggccccagtgcctgcctcctccagccacaccgaggcttgaacctcgaggacccccggcccctgaggtggtcaagcagccaggtatggcttcccacattcccacaggagccatggcaaaggccaaaggggccaagggaggccactgtccccacaccccatgcttcccttcgagagggggatttgctccctccaacaggacagtttccaggagcatatgttcggtattgacctggtcaagtttcctagctactctctcccctcgcctgtccaaaactccacatatgctctgcccaggaagcagggatgagcggggagagtacacggcatattggtggctccaaacttcctcccaagcgatgctgtctcagatgtgcccctcctgcctcctccgggggtgctgcggttcaggtggtcctgacccagctgggacccacttcacatccccaagccctgccctcccctgtgtggtgccagcaggaggagcggccctcaccacgcccgtcctcctccctctctgcctcagtgtaccttcccagcaaggccggccccaaggccccgactgcctgcctgccaccacccaggccccagaggccagtgaccaaggcccgccggccaccaccccggccccaccggcgagcagagaccaaggcccgcctgccaccacccaggccccagagaccagcagagaccaaggtccctgaggagatccccccagaagtggtgcaggagtatgtggacatcatggaggagctgctggggccttctctcggggccacgggggagcccgagaaacaacgggaagagggcgaagtgaagcagccacaggaagaggactggacgcccccagacccgggcctcctgagctacactgacaagctgtgttcccagaaagacttcgtcaccaaggtgggctggcctggagtgctggggtctgctggattccagggggtggcactcccaggtccttggaattaagctctgttccttagctactcagcagtgtgtgtatttccaaggatttgagtgtctgtgtatgtgattgtgtgtgtctgtgtgttgctgtgtgtttgtgtctgtggtttgttactgtgtgtctttgtgtgtctgtgtgggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggagctggagcaggaggaaggactcacccttgcccaggtaccccaggggcaggagggacctggcacacaaggcccacctgattgtctaatcccccccgctggggatgctcggcttcttggggagccactctggagtgggaagatgcaggttcagagggagtaggatggacaggagccagggaggggagtcagcatgcaagctgtggtgaggcccaacgggaggcccggcagagccacaccctctctctttgacataaagcccagctgcctcaggcttccctacctgccgcctaagtgccctggtctccaccaccctgggccccgctcacacctggggcagtgcccgtaagtgccccctttcctcccgcagctagtggagaagcgcctcctacccttgaaggagaaacagcatgcgagggcagcccctagtcgtggcacagcccggttggactcaagttcttctaagtttgcagctggccaaggagcagagagagacgtccctgacccccaacaaggggttggcatggaaacctgcccaccccagacgactgcccgggactctcagggacgaggcagagcacacactggcatggccaggtccaaagactctgttgtgcttttgggatgtcaggattcccctgggctgagggctgcccggccaacctctcctccccaggaccacagacccacctgccctggcgtgggtaccaaggatgccttggatctccctggagggtctcctgtcagggagtcacatgggctggctcaggggtcaagtgaggaggaggaactccccagcctggccttcctcttgggttcccagcacaagcttctgccctggtggctaccccagagccctgtccctgcctcgggccttctcagcccagaaaagtggggaccccagggaactcatcagtccccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggccttagctttggagggtaggggagggaggggagggagagggtggcctgaatggggagggcaggaagggagggtctggggggaaggggctggggagtgggggtgggaagcagtgtgttgggggcctcgtgtgtaagtgtgaataaatgtagttgtcttggaaaatgctcttggggctgctgcctctgtcctcggtgctgtgctgctccgtggagggtgtctgtgagggagggcagaggaactggcagatgccaggctctgggaacccacagaggccggccccactctttcctcctgacgtagggagccccttcagatgctccagggactgacagatgctgaggaagccctgatccctcccaccacccactcacaaggccctgcctgctttagggaggcttcttggggccccctcatcgttatcagcatccctggaaaatcctgggattggagagagctggctggctcttgttctgctcggtgggagctgaggagaaggcagccgcctgcaacatggacatggggagaggaggctgctcctgcttaaccctcatcaggaagagcgcgggcactgggctgaggggagacgttgaggtgaccatccacacaggtgtgtttgggatacgatgatgggtggggagcaggggaagtccttctgcctgtttctgggcaggagagagtcttgtccaactagctaaagcagatgctccttgctgtggccacagggactggcctcggggccctcaaggtcctgcatggagccccccacagctatgattcccttcccatatgatgactgaactcatgtggaattgatgtagacacagatttacattggtttctaaaacagttccctcccaacacaccatcaccaatgggaacaagcatgtccagtccatcaggcgcagggtgggggtttctgctggttccagggcccggaggagctggggcccaggccaagaggggccgagggtcagccgcccttctgccaggcacagaccccaagggcagagcaggggctgcctgggatgtggcattggctgtctgggaagtgccctgggagttgggggctaggtgttcgccaaagggagacttccagagtctatgagtgagatgaggactgcatcaggagagggaccgaggctggggaggatgctctgctctttcccaggttgtcctgtcttcccaatctctgctgaactgccctcaccccatgggccaactctgccccccttacccctaacccacctcttagaatctcagatcccagcgtggacaggacccggcacccaccctggttccctcctggccaacaccttcttctccacggtctgagttctgattcctcccccagggcgcttattggctcaggacccctgtgactgccagggcactggtcccagcactgcctgcgtgcagagctgtggtcacggccctgggggctggcccagcagcagaggctggtggggcaaagctgtctggtacacggtggcctggcccctcggccaagtgacaaagggagccatgtttgggtcctctctggccccatctgcccacagaacacagcagtcagcctgacagatgcccctctgccccgtcccttctgctcgatgtgggcagtgtcggaggcctgctgtcttctgtggcctttgggaaggagagtttatcttggcagggcttccccagctcagtgcacgtcaggccctcggggaaaatgtggggagcgaagagtcactggtgggtgatgtgggcagctcccgtgactcctctacattcacggccatcctcaggagataaggtagcactgcccctttgcagggtttaggaatgttaagtgagccgtgtttgaagggaacatggtccatactctggcgtgtgtgggtgcccagccaacttcctcacctaagggtgaaagtgacaccttggggctcctgctggttaccccactggctgttgtctatcccactgtccctgtccttgtcttggctgagccattcctaggaagcagaacttgtgcttcctccacctctgtgtcccacctgagccctacaatctgcccctaaatgggcacagtggggctgactggggggctctggtagactgaacatacgtcccccgcccagttcctgtgctgaagccctaacccccaacgtgatggtatttggaaatggggcctttgggagttattcagggttagaagagaccatgagggtggggccctaatgatgggattagggccctggtaagaagcagagaccccagagctctctctctccctgacacgaggacacactgagaaggcggccatctgcaagccagagagagagccctcaccagaaccttgcccactgggatgctaacctcggacttccagcctccagactgtgacaaatacatttctttttttaatatgtgccaccacccccaagtctatggccctttgtccgagcagccctatgtgactaggacaaagtccataatctcaagaacttccttcatgactggtatctggaaaccgtgcatcagagccacgggaaagaaaggctcagccctttacaactgtcagcacacctccaccccaagtgcagtgtatcacacatgaaccaggagagcctgggacacagtgaaaaggaatctgtaaatacccatgatgtcatcgcatccacacttggggaagccatgcagcttgctcacagcaggtgctgggggtgtgctgaggctcttggtcggcttggcctccctgctcacacacccaggtcactctctgggaaccagtgcggctggggtggcccctggcaggtttgcctccagagacccctcccttcaccattggatgacagatccccgaagaagccatagcctcctgggaaactccatctgacaacgtgagcaaggcttgcccccgttagtgaacatgctgtgctttctgacagctatgaggatggacttgatccaggtggctgcccttttgtagctcactttgattctaacttcagcgttgcatgatgccctatgaatggaatatacaatgtgtgtctttcacatctgtcttctttcacttagaataatatttccaatggcatctacatttttagtatgtatcattacatcaaacctttttgttgctgaataatattccattaatggatatactaaaatttatccatttatcagttaagaacgtttgggtttttttcactttttggctattgtgaataacacttctaagaacatttgtgtacaaggtttcctggggatgtatgtttccatttctcatggctacatacctaagagtgaaattggtggaccatatggaaactctgtgtttaaccatttcagaaggtgccagactgttcccagtgtacatgaaccattttatatacccactagctgtgtgagggtcccagcgtctctccatattcgagccaacatttattatcaactctctttttgataaagtcatcctagtggttctgaagttgcatctcatcgtagtttgcatttgtgtttctctgatgttgaacctctttcacgtacctattcgccacttgtatatcttctttggagcaatgtgtactcaacatttagtaatttttaactggtttgtgttttgtcattgagttataagaattctttatatattccagataaaaatgctttacaagatataatttgcagaaatattctccttctgtgggttgtcctttactttcttgatggtactctttgaagcacaaaagtttttactttggatgaagtccaatttatctattttttcttttgttacttgtggttttgatgtcatgtttaagaaaccgttaactagtcttaggtcatgaaatttattcctatgctttttccttttttaaaaaccatcttaaacattttaaattgtacaatttagtaatgttatgtatattcacatcattgtgaaatttagatctttagaaattttttatctttcacaactgaaattttgtacacattaaatactaattttccccctactcccacccccggcccttggcaaccactactttatgtttctgtgatttcgactaccttaaatacttcatatgaagggaaagtatttgtccttttgtgattggcttatttcacttagcataatgttcttgagattgatccatgttctagcatgtgacatgatttccttctttccgtaggctgcttagtcttccattgtatgtatataccatattttatcctttcatccaccaatggatatttggattgcatctcttggctactgtgaataatgctgtaatagggattgtatggaatttgtaaattgttttaggtaatatggacattttaacaatattaagtcttcaaatccacatgcatggagatgtcttttcatttatttatatactctttgatttcttgtagcattgttgttttgtaatttttagtgtccaagttgtttgcctccttggttaagtttatttctaagtattttgttctttttcatgctattataaataaaattgtgggttttttgtttttgtttgtttgtttgtttatttgtttgtttttgtagtagagacaggatttcactatgttggccaggctggtctcaaactcctggcctcaagtgatccgcctgcctcagcctcccaacatgttgggatcacaagtgtaagctgccgcacctggtctgaaattttcttcttaatttcctttccatattggtcattgctaatgtatggaactgcaatggatttttgtgtgttaattttgcattttgtaactttgcggaaatcatttattagttcttacaggtttttggtggaatttttagggttttctacatataaaaccatataatctgtaaatagaaataattttacttcttcctttccaactggaatgccttttatatatcttttccttgtctaattgctctggcccagtactacgttgaatagaagtggcaagagtgggcatccttgactttctcctgtactttgaggaatagctttgtcttccactagtaaacataatgttagttgtgggcatttcatgtaaggcctttattatgtggtagtattttccttttattcctagtttgttgagtgtttttaatcatgaaatggtgttgaattttgttgaatgctttgtctgaatcatgtggtttctgtctttcattatattaatgtggtgtatgacttgattgatttttgtatcttcactcatccttgcattccaagtataaatccaacttggtcatgatgtataatcttttttttctttgagatggagtctcactctgtcacccaggctgcagtgcagtggcgcaatctcggctcactgcaacctctgcctcccaggttcaagtgattctcctgcctcagcctcctgagtaactgggattacaggcacctgccaccaagcctggctaatttttgtatttttagtagagacggggttttaccatcttggctaggctggttttgaattcctgacctcgtggctctgacatggcaactttgctgagcagtacagggtgttcttgtccaggagtccatggaccttcaggcaatctagcaaaatttggagtctgtgatgggcttggaaatttcagtgaagatttgggagtgtcctaaccccagctatttaagagcctctgctttagatggtgtgagggacccaacaaccacattctatatagctgtcctgggcatgcttggtcttcccagcaatgaattttctgtggtgtggtctcagagctcacttcactccaccctgagactcttgtacagtgaagtgcaaggatgtggccaggccaattgtcagcagtcagctcctggcctgcctaactcaatatagagcatgcgtccactgtgtgctactctgctgcccagagtcatcaggctcatgagccagatacaaatgctgagtctggggcctgcgtgcccgagaggccctttcctgtcagttggcccagggagcatcacacagggcactcttctcctcagtctctctcgcatctctctggcagacaggtggtcatgatcgtcagtgctgtggggccctattattccagagcaaatgctggagccagacttaccctgtggaaatgcacgaggacgtgggctgtggtgatgggcaccctcagtcaggcaccagctgtcccgcgttcctggcttccacctctggggcagctccccgacattctctgaagtctgtccacttcgttttctgttacatttgcccttgtcagggggagcagtgggctttggcctgtttacctaagccctcatgtgtgtgctgcagcctggcttgggacacatttggtctccatgtgaagaccgagattgcaactttctgtgcttggagcccaaaaggacaggtggggcctgagggagggatgcccccatcccaggacaaggaacttcccccaggagagctgctcatggccccctgtaactcccaactcccatggaggggctgacaggggctccctgcaagctgaggctctgagcacagggacacctggggccccacataccagccccatgagaaatagggccaaagagcctcattccccctgtgagtggctggtcacccacacttcagggcctcatcctgcgctgatctgcacctgacatgctgagtcttccttgggcttcatcccctggagtcgtcccctattcctggctcccatgctggtggccctgccttctcccccaggcacccaaggactctccaggccatacctcagtgacagcagctttgccatcccactggcctcaaccccagaaaaacttcaagagagcaaggcccaggattttaaaagggctaagactaatgttacagaaaatggactgtgagataaggaattttcacaagtattctccaatttatgcagagaatgaaacagaaattgtggaattcaaagttgcaaaaaacaacactaagaaatagtggtttaagcggatgatgctttcatggattcagggaaatgactgctatccacagagtgtgcagaggaagtgcctggtcctggtgggtagcatggctgtggctcatccaagagaatgagacagggctgggcaagccttatatgtggaattcaccagagtgaagcttggccagtgatgcaagggaaggaccacgatgctgaaggtgttgactaccaatttttgccaccatcaaccctgattcaaagcatttgctgaagaaccagagcagactgacagtgagattttgggcccctgggccagtcatccctacaaaatgaaatatttctctaagaacaggacaatgagtcaccattttcccaaaccacagaccatatcttaatagaacaactttttaaaaagtttttattttattttaaagttccaggatacatgtgcagaatgtacagtttcattacataggtatacatgggccatggtggtttgttgcacctatcaacccatcttctaggttttaagccctgcctgcattaggtatttgtcctaatgctctccctccccttgaccctgaccccctgacccccaacaggccccggtgtgtgatgttcccctccctgtgtctatgtcttctcattgaatagaacaacttttaaaaatgtgcagctggagcagccttgaagggaattggtaagcagtgagtggagagtgatgtgtttcagggaggatttggactgtctggcttgcaggtgaccctcttgtcccacagaggcagtctgccagtaactcatcaggaagcccaggtagtcttcctcaggcacttccatcattcctgggatggcagagatgaaaagggactggaagagatgggggcagagaacagccctcactgacagcacagagcctcacctctccacacagtctctgtctcctctcctcctctgcccacacagtgactcccagccgctaagattcctgctttcagcaatgcccgatagcacaccaaatatctgaggagttctcaaacaccaactcttcactgcccattagcacaatgaagaaactgaggaaaatgtatatgtccctgaatgttgctaatggtcttagggcaaactgctacttattctgcattatgtatttcttagttaattggggttaggatgtcatttttaatgaaatgatgttaatagtgtttgtaaaatgaacgatgtgcaaccccatgaaaaactctgtgctttttgaaggagtaaaggaagcaaggaggtgtgataaaaattttgattgttgaagtggcatgggggcaggttgaacttgtccaagactgcttccctgcaggccagcctccttaaatgcttcatgaatgctctccatcgctgggcataaggtcatcaaggctgagttctagtagaagagacattctagaggtctagaatgtcttatacaaacacacttagagacacctgttctagtagtccaccattgcctccactccttaggtcttgaagcaaaatcatattcattcattctacaagtatctactcaagatgtgatatttgtcaggtgagtgatgagcacaatggttgataggcagagacaaacaataataaaaaaatgagtaataaagggtaatgaaggctgggcgtggtggctcatgcttgtaatcccggcactttgggaggcggaggcaggtggatcacctgaggtcaggagttcgggaccagtctggccaacatggtgaaaccctgtctttactaaacatacaaaaattagccgggtgtggtggcctctgctgaactctcttttgtgttttaatgtaaggttaaggagctcctgggcctttggggattctcagccaaaccaggtcccatcatcatggctttctcccgtctctgcacgggcggacagataatctgctgctgcacacaggacacacagagctcacccctgctcactcaggctcacctcctaggatgcctcctaggcaggcagaagttgaggctggctcgccacactcacattctgggaccagggacctgcacctgcccttgctacactcaactgtctctcgggctgtcaccactgccctcagaagagctcacactgctggggagcccaactgtttctcaggctcttgccaagaggtggcaagagagtttcccctacttacctgcccactgggaacaaaactttatttactttttattgaggtaaaacagatttaacagaaactaccattttcatcatttttgagtacagggtttattggcgttaagtttattcacattgttttctcaccatcaccgtcaattcatctcaagaactttctcatcatcccagtatcagactctgaacccattaaacacacagctcactgctcccctttttccaagtcccttaatttgaagtgcaatgaggagactatttttgaaattagaatgttcactttttgttgactttctccatgaaaaccttcccttgatttagtcagaagtccccacaccctggtttctgggacagattcctcccaggcctcaggagactgtgccccatctgctgatgatgccataatgggaccccaacaggaaaaccaggatatctaatgtgcaagggcggggttttcaggggagaggaggggggttcccgagaattctggtagcatgtctggaactagagccttgcgtgggaagtgcggcatttttctatcagtgaagcactgatagaaaaaatggggagacaccttctgagggggcatcacaggcaggggagaggagaggcagacaagcactggctgcacttatactcaggccactgagcagcggaaacagtccagagtgtgtggtgccactttcccattgggatgttgtgccttttcttaccaatttttgagaacttttggaatattatggataatattaaggataataatccctttcccagttccgggctgctccctgtggccagagaaggcagccttgaaggtgttgggtaaagaccacctgcccagctctccaggcttgctaatgcgggggaaggagatgcagcccaaggatcctgaagctcttgcatcaagtagctatactccacccagagctgccggccacaggtccagtgaaagaaaactgtcaggaccaccactgctgctgccaccaacccctccccggcaatagaggtggaatagagatgacctgcccccacctgctaagcttccctgcctatctcctgagggattcctgggcaacgtggataagaaggacaccagtagaacatcagaatccaggagactaaaacagctgcttgggaagataaagaagacatggcagggcaggcatggtggctcacacccgtaatccgagcactttgggaagctgaggcgggcagatcacgaggtcgagagatcgagaccatcctggccaacacggtgaaaccccgtctttactgaaaatacaaaaattagccgggcatggtggctcgtgcctgtagtcccagctactcaagaggctgaggcaggacaatggcttgaactcgggaggtggaggttgcagtgagtggagattgcaccactgcactccagcctggcgacagaacgagattccgcctcaaaaaagaagacatggcaaactgcagtgccacccagcctgcccctgctgtctccacacctgctgagactccctgcccgggccacctacacttcacagatcccagctcctcctcctacctctgacttggcccacatggctgctgggcccctcaccctgcctgtccctccaccttcgcccacaccaagaattgagtaaaaattgatatccataattcctaactctccccggggtcttcctgctgaacttgcccccattttgggggttccacctaatgagaaaggaggctgccctcattcagctgcagcttcagcacctctgacctctcagccctgccccatacctcctagccccgcatctttctccttccagcttcccttcagaagggagcctcctacacccatatgtgttttcctctcctcctctttcctccccaactcctcttccagcaccttccaccgggatccctgctatcactcatcagcagatgaattccacagcagccatttccaccatcacagcaagggcatctgcccacctgaccttgcagcctccttgagccctcagctctttgctatggacatgacttccactactaacgctgtggttttcaaatcttcaccaagctccagagtgagcaccctcttaatttcccaaattcagtgcacaatagaggcaccctggaaagacatcggcttacgtctgcctggctacattcatattctccaggcccacccctcagcccacacttggggccccctgatgggcagcaatgaaaagcctctgtccccagtgcccctgtttttccaagccttcccatcagggctcctccaggcaactccagtttatggagcagcgtctctgcaacatcctcctccagaacagattgtgcgatggggaatggcaccacaactgctgcaactgaacacaattagggtccccattcagaaagagcgcccaaggcccacctggtacacacaggtggtatgatgaggaacaaataagaagcaagtctccctccacatatggtccccatgaatggacattgctcctggaggaaggggctcagtccattgaagttaaatttaagctgctctctccttataaaagccagaggccccaaacctcaaagtgtgtgtgtgtgtgtgtgtgtgtgcgcgtgtgtgtgttggaggaggatgtggggctgatgagcccaatcagaaccacagtgtatttgaggcactcccctgtggacagaagaagaagccagcatgtgtcatcatcatctgtgccctccccggcttgactgttcatctggctgaccaaagcccccagccaggtctctattctttgaactggcaggatgcccgctgctatttccaggtgcccctcttccccttgcctgtttactttgatgggctcttctctgtcctgattgtaaattaaaaccttattcttgttgctctgcctctgttcatgtgtctatatattttataatatatatcttacatattttaatttttaattaaatattatatatattaattatatgtaaccttaaaactagatataaagaatgtaggcatgtagataccttgcaaccataaaacctaaagaaacttgcagatcaacaaatgcagagacctcataaaattcaaatgacaatattaatataatggaacaaaggcagaacagtcactcccctccgctgtgaggaagtggcgccccctgtccacatgcagactctcctgagacccgcctgttggcggtgtgctttgcagtaattggctgcttccaccacttgtccctatgtaagttacacagaggcttcctttgcacatcctgtaatgaagccttttggccttcacttggtgagaacacaatatttcatattaactccctgtgcattcttttttttctttaatatttctctataacaaagaaaatgtcatgccctggcaccaaagaaatgttaaatagataaaaatatggaagctctctgttaagtcgatcatccaaatgaaccaaaatatgttgatcttgatcggtcactccacatctccagcaatatgaccctgtaggcacctgatctcctccattaacattttatttacaaaatcagacttcaggccaaagctggctatggtttgctgacccctgttctagtagaagagacattcaacaactaattacacaaataacaaccactaagtgctatcaagtaaaagtacccaatgcttaaaaccctctaagagtagagattgaacctatgcaggtagatcagattgccctgagggagtgggtcttagattaaacgtagttaattagtcaggtgagggcaagactactccagatggaggaaaccacctggggaaagggttggggcagaagacagcctggcaaacccagtttgaaagaggcttatggagcgggagcaggaagagtgagggccagcgcctgtgagctcaggctgaaaacagcagggaggccagcccctgtgaggtcctgtgggtcttgtgagggaattaggtctctatttaaatacagagactgcagcacaagacaagatggagttggaagcctcctctgttcacctccagacccaccttctgtatcctctttgtgttcattttggttctaggcttgcccagtgtctttacaagttttcctccatgcaattccaaaatcttccaacaaaacaaaaaggaaaggaaattttgtctgcacctaggctatcctatagtggaggacctagaggactggagagagctgtgttcctgcttctcctttcctctctgatgcccccttatatggagtcttagcaaagctttctctgtcctcgatgtcaaaggagccttcagaatatcacctgggctcctcctcctgtgttaccatgccttctgggtctcgccctgcccgcctccgcactctgtcctcactgcctcacttccacgctccccttggggacacttgcacagcttgctgccccgtgaatgctccatgtccccttttcagttccacgttgttcctctgctggaagagcatgtgcctcgcccggcccctttgtctggacaccttcttttctttaagaatccacccaggaatggctcctgatgcttccaggtctgcaggaagccatccccggccccttcctcatccagcctgagcgctgtgctcccctgcagtgtccacacagttcccggtatgaaagactgacatcccaaactactgttcacgtcagcctcctgcaccgcaccctgagcttgtgagctctatgacagcaaagggcttatgtgaagggcgtttggcactttccacgtgaagtttaacccatttaccttgttaattcccatttgttcccacctcttaggtacccgcatatttctatccttcagatttcctagcactgggccttatagcagcatttcttaaaatggggtccccagtccaacagcatcagcatcacatgggaatttgctggaaatgcaacttctggagtcctccttggacccctgggatctaaaactctggggttaggtgcagcgatctgtgctttcataacccctccagctgacactgaggccggctaacgtttgagaaccacggcctcccaggaagtcactgctcatgaaattgttgattccctgaggacagtaactggttattttcaatctgaaaaagaaaaagagtaactggaggaaatgacaaagaaaatttttactttagaaaaagaattttccaacttgatatttcaaatacgtgacttccaaagaaggcctagctttgtacatttaaaaacaaggttgattctgcctggctcagtctaccccacgtgtggttttgctgaagggcaggtgtttggaagagataaccttaccaggtgccctccactgctcagattctctgcttctaggatattctatgtagcataaaataaatataagctagagaggagggcatgcttgctaggggagtaaaaagatggtttctgttttgcaggatgaaagtattcatggatggatggtggtgttggttgcataaaaatgtgaatgtatttaatgccaccaatctgtgcagttcaagatagttaaaatgatcaattttatgttatttatgttttaccacattttgaaaataaaaataaaaagataaagctggcacctaaaaatgtccaggtaacaataaatctggcagagtgaagtacaggactacccattgtatttagagcagcccagcaaagcagaggcccctagagaaatgggggataagaaaagtgaaagattgttatttccaaaataaccacctacaaagtacaaagtggtcttcctaatgggaagaagtgattgttccttggctcattttcttttttttcctttttttttttttttttttttttttttttttttagttttcagggtttttgttcagtttgaattcatatgtgggaggatgtcatagtgtttgcaggcctttggattcttgagaacttaatcaggccaagctgttcatgaggagtggggtgctcaaattcattcttccaacaaggggctgttgggtaccactatggtgccagccctgtgctggccacaggtatgaaatgcccagtgagggccacatcctggctcacctaccaggccacgggctgagccccacagttgcctgagaaatttgctttcaggggtaatttgtagagattgtagctgagctttgggtgacaacctgaggtgcggtcagactttatcatcacaaccaaaagtcacatgctgatgagaggctccaaacaacacctggagcccatgacccagcaacttccagatgttgagttgggacagggaacaggcttgtctgctccaaatgaatgccctgaccagaaagagtaaaccagggaggcactcttgaaagagcgtgttaaggagcagtgagcccccttccacctccaccaggaaacgtccccaggacagacagctgccgacctctttctggaagcgctgggcctcagaagattgctggttcctgcctacttgctcccaaggcatattcttgatcagaaaggagggaagaagtgcgtaggcatggggaggaggggcagggaagaagtcacaggaatgcccacagcagaggtctgtggagatgctgggctatccctggtggcaacactcttggggctggcgctgggtgaggatggcctccaaagcaccctatgctgtgactccagcccccgggatcctcctcagggtacagagaaggagctcaggtgagctctgggtggatgataccgtctttttccattgaaatcacagaattttacagctaaagagaacttccagatgatttcagtcaaccacactcttttgggggctggaagcagagatgaaaagatttagacaaaattacacagttcaatgattaacaattcagactaagtgtcaggccatctgaccacaactgaggccccccgatactactctactaagtgtattatactgtggtgtgtatgtaggtgtgtgtgcacatgtgtgtgaatgtgtgtcaggactacatgtatatacatgcgtattgtgtgagtatgtgtgtatttgggcatctgtacataagtgtatgtgtataggtgtgttgtgtgcatacatgctcatatgtgtaatgagttagtgtgcatgtacttatgtgtgtattgagcatgtgtgtaattctatgtgtttgtgggtgcacatatatgtgtatttgtgtgtgcttagtgagcgcttcgctggccataatggcttgtttttctggccaaaagacgtgattctccctgattcagccgtgagtgtgcatttcccagggtcagggtgactaaccaggacatccggagaactttcttcttctctgccccacccatcctgcctactccattctcgggtgtcagaggctgaggctctggccccagtgtgagccccacaggaggtcttcagagccctcaggttgcctcacagccagcctccatgagcatctttctgttttccaagagggtgagccagggctgctcctgtcaatgacaagatgctgggacctggattcacgtgcaaggagaaaccaggcactgggggctgagcgtccagctgctgctgggctgggagtcagcaacctctgtgcttccagggctcaccctccctggccatgggcagtgccccttggctttgcggcaatttgaggcaatgaaagtttttatttcctctggctgtattttctagacatattttaacgtagctataatcttacaaaatgttgaattttttgtcctgcttttaaaaagattttaattaggttagattataaccaaggcaggtggatcacctgaggttgggagttcaagaccagcctgaccaacatggagaaaccccatctctactaaaaatacaaaattagctgggtatggtggcacatgcctgtaatcccagttactcgggaggctgaggcaggagaatcgtttgaacccggaaggcagaggttgcaatgagctgagatcgtgccattgcacaccagcctgggcaacaagagccaaacctcatctcaaaaaaagtaaataaataaataaataaaaatgactaataaatacttactgaaagtataagtataaaaaactttaattatgttaattatgagattttaaaactgtattactggagaaaagagaccaaatctcctcataatactttttttgtttatttaataataaagatgaacataaacacctgtgcaattcagtgtttaaagtttgccaaggtatatgtatatatttttcccaacgttgatgctgtgagaagcccaagccatggagaggccccaggcaggtgctctggtcaacagcccaagctaaatgcccagccaacaccagcatctgcaaccagccctgtgagtgagggtttgcagatgtctagtctcgtcaagccctgcagatgtctagtcccatcaagccctacagatgtctccagcacagatagagcctacagatgtctccccgtgaaaccacacagccaagtccaggcggaaaatgtgaaagatgtttctaccaagccactgagtttctgggtggtttgttttacagtaatagaggagaaccagaacggtctgttcctgcactctccagtggtcccctatgttcaaacactccgcttagcaagcttcatcacccaacacctggacctaatcactctgcagggtctctcactgcagtcatttctcagggttactgacatgctagtctctgctaagatgctcacctcttcaccttcccttagtgactggctgctctggttgatattgtctttcccttcctcccagaaaccctccctcattacctccctttccctaacagttgcagctccttgaggtcagggcctgtctcttccaccatggtgataacctgcatatgttggctgctgcataaattctaactgtatcaaatctaggacccaacctgcacagttaagggatttaccttgggaatcttcccaatcttcttgctaacatgggctacttttattataaaatttcacagttgccatttttgtcattttatgtcaaaaagatggttttagcaacaactagggaagggcacgtaagagtccagcatggcacatgatccagttcagatgaacttaaatggagcctgctggaggctttgtgggatgagaccccattgtcctcctagttttcttcctgaaagattatggagtctattcactaaacacttctaactatcttttatttttttttcagtgggaacatgagacttttgaaaaaacacaggtgatgaaactatgtgctcttttagccaatacaatgtgggaagtttttctgttggttaaaataattcaggtgcttacaggtagcttggtgtgaatgtggccacagactctcagtttgggtcctcttgtctgtcttccaccttccaaggccagcacaccattcctgaagcccagcctcacaccctggagtttatccctcatcctttgaggacccaaagacaaacagccttgccaacgcactagtgccttctctcacctcaactgtaaagtggccatggggtcttcaccagcagctggggaagatgctccagaaactggccctgatagctttgccctgtaacttgactgggttgcaaacattgtgggtgagataaacatgatctctaaggctctttttcagtattgaaattacatgtatgtctgatcactttaaagaaaaatgtgaattttttctttattaaaacaattttcctttgtccttatagatcgtttgtcatattttgcttcaatcaagagttgtgtcagacacaaccactgggcagctgacatgagatctgcacatttgttactagaagagccagaaggccacccactgttcctcctagtgaaccactggtagagcaggtatggcttagagcccagtttcatgcttgactactgatatggtttggctgtgttccacccaaatctcatcttgaattttaactcccacaattcccacatgttgtgggaggaacctgatgggaggtaattgaatcatgggggcaggtctttcccatgctgttctcataatagtgaataagtctcacgagagctgatggttttataaggggaaacccctttcgcttgactctcattgtcttctcttttctgctgccatgtgagacatgcctttcaccttctgtcatgattgtgaggcctccccaaccacgtggaactgtgagtccattaaatctctttcttttataaattgcccagtcttgggtatgtctttatcagcagcgtgaaaacagactaatacaactacacaaaaaagtcagtgcttcaaaacagaaagaagccccaccagtacatttgaaattacagtttatttaaacaggtaaaattgtatatatccttttaaaatgaaaatacaaagtaagtgaatcaataatacaaacatgtttatagcagtaattaaaatacaggtaacatttaccagtgtgaaaatatcagaattccactcacacttggatcttcaatgattgaagtgtgcattcaacacagcaggtgctggtagattgaagataaattcctcctttggatgtgccatcctcagtcaagttcttcctcatcaccatccatcagctcacacagtggggtagctggctgctgtggcaattccacagttgttcctccggtctttggccatctttatgtagccatccatgccccagtttttaccccagctgaaaggagagcaggttttccatttcagaggaaggataaagcacactgggttattaatttgaacagtgagccagaagccacagtgtgccagaagccacagccttaacataaagaatcaggagatgctgatgttcctgttcatcccttgtaaattcttgagtcaaaacctgcatatcgcttcaatcccagacccaaaactgtgacctttcacagaactgcaaaatcagaaacagaaaaaggataggatgtctttccagccgatctacttcagaattaagaaaatgttcagaatttagacatgcaatgggacaaataccatattaatatccccagcatgcttgtgacagtatcttgatgttacaatcaatcattaatattctgtgttctgcctaagggggaaaaagacttctgggatttcagaaatgtgattaagggcttgtggtatgtaaatactgattgcaaaaaaggattcccttttgaatttcaactataagtctttctggcaatttatacctgttcttcaccagccaatatttattgttatctgagtctgctccttcatagctgtagccaaccaccagcatagcatgatccaggccttcagggtcacagcgtggctcaaaataaattcctgagagaataaaatgaaggctgggtgagaagttcccaaggacacctgacagtaacccaccctgtcacccacagggagggaggcatctctaaaatcagtgaaatgacacacagtccagatcgggcttaacaagatctattgttatcaaggctagggaattaggctctcatccacaactagcagaaatagaaattagcataagtccctcataaaaaaactttcctacaggcataaaagaccactcattttaagcttgtaattctactctagaatatcaatcttaaaaatagcacagaacaccaaaatccttgactcaaaaggctcttttcagatttaatcacagaagtaaaaatctttggaaaaattataagaatacaacaattagacaatatttaagtaaattaaactatactataaataacatagctatttataaaaagttatgaagtacaggtattcatggagatacgctcaatgtaatatcaaatagaagcattgggtatgattattgcgtgtatagagtccatcatgctggtgtgtcatggtggtttactttttttctgcaataatttctatgaagaaagatgcttaccttttttatagaactggaagaagacatggcttgcaccaacagcaacagagatgggccccacagttgccactgccttcgccaggtccttctcccgtgaagggatgtccacaaaaccagtgtcattagcagcagaatacttgggattgtacctacaggttttaaccttttaaaggtgaagagggaggtgacttgattactaccatccttctcctggggaatgtgagtcagaaccacaacactcagcagtttgcagcatagaatttccaagtcaacactgttacaaatcatccaaggaagtgaaatgttattattaatagttaatttgaaactgaaaattagctcagttctcttcagtgagacccccaggtttactttccgtaagacatttttcacaatggagacatctgtattatatgtagaatggtttgtatattctccatgtcacatagaagcaagaacagctgcatgttaaccatgtaatcacagaactgtgcaaaggctataatttataatgacaacactgtcactttgcagatagagattccaccatctaaaacgtgaattctgaaaagtgtctgttatctctgaaagtgtcccagtaaaaccaagcaggaatggcagcaagaaaaggagctccatttacctttccttcatatggataggatgcctcagagtccaggcctccgttctcctgaacataccggaagggattatccatgaagtcaccattgcagccctcattgccttgaggcccagagcagtctaccagattctgctcattcagtgagataagtttgcctgttttccagaacatctgcccttccagagcaccagttgcactaaaagcccaacaagagccacactgaccctgaaaagagaataaaaaagctgatacacacacacacacacacacacacacacacagcaagacttttaacaacatgagtatttagctcatgtagctaaatactcctttaaaaagtgaactgcatgttgctgcacagtctaccatagcacaaatgtcaattgcttcttggctttcctggggtgatgggaggtctgaacctaacacagtctcacctgatccttcacaggagtcatgtagcctttctctctccagtccacagatgtggggatctcaagaagcaggcgttcctggaactgtttccccttcctgtgcttctggtattgaaaaccattcatcacctgcctgaattcttcattggtcttcaaagaaaagtaaataaaatgttaagaagcaagagattaatttggtaaagaactgaggaggggaagcacagagctgggcagcccacagcatacttaccatgtctccaaaggcgttcatggccattgtgaagctgtgtttcccttggctgtattcctgattgtgctgctcaatcatcttcacgtccttctctcacactgctctcctccatccttctccattctaaaggcaaacatgtaactgaggctcttcatttcttttttttttttgagacggagtctcgctctgtcgcccaggctggagtgcagtggcacgatctcagctcactgcaagctctgcctcccgggttcatgccattctcctgcctcagtctcccgagtagctggaactacaggcgcctgccaccatgctaactttttgtattttttttttagtagagacagggtttcaccgtgttagccaggatggtctcaatctcctgactttgtgatctgcctgcctcggcctcccaaagtgctggtattacaggcgtgagccaccgtgccccgccgatgctatttatttctaattaaaacccaacatatgctaaccaagtgaatcttcagacagagatgtaagagtaaccatggccagggaaggcttgacacttctaggagatgttctccaagctaagacacaacaagggtgtatgcccatatcgtgctcataatcagtgctattaagttattgcattaggttattggtaggagccagcctctagaagccactctctggccatatgatcccaatagcaatgcccatctctctggggttcccctggacagtttcagatgccaccaaccatgccatataatctcttgtgctttgccttccacttggtccattgtgcgtctaaactgtggtcacgtgttagagcagctgaggcaattcccaggcaaaaggcagccaggaggagtgaaggattcatgtttcaaaaatctaggaagggaaaagaaatgaggatctgattagaccgatcctaaaaagccattttactacgccctgagaaactagaggcaccatggtagaaaaaaaatatttaaattattcttccaagcatttacctaaggactgtggaagaggccaaggatgtggctggagaaaaacagggcaagtggaggtattggatggacccaccaaaatgaaaagcagcctgtccagagctgtaggagttgaaacagttttatggggtgatgatgacaggctatgaaaaggacaggaaggtacctgatgggcgagaagcttaaggcaacaaccaggaaactaggaaaccgtcggcccaggttttgtcccaattgtgctgaggtcatccaggcaaaacctcaagaatgaagacatctaatttcaagaagggacaaagggatccccaataattgggaagtcacgtcacaccttgttcttggctaatacacagcagaaggtgaagtatgttttccaaatgccccttgtaatgaaacagttcttgaatgtcttcccaggacaaactgggaaggggagcacctatctaccgccgttcccgcggtcctgcagtcctgcaggtgggccagtcctgccaactctccaactcccctcgcagagcataaactgaatcaggtggccgaaccaccggacgccagagtccccagtgtccgcgcccacacaggcgtaggcagcttcccaggctttgggctggggacccaggccaggtcccctggctcttgctcccgccctccgctcatgctcactgtggccccaggacgtgggcgatgttgcagggagcaaggggcgcctctgcctgacttgccggggtcgagcctccctgtcccaccccaccagccctgggaatactgcggcctggcactcccgaaaatccctcactcacagagctgaaggacttgctgggtccctggtggcccctgtccaatcttagcccactggggtctcagctgctgtagccacaggtggacaggcacagtgggcaggtgctgggtccaggagtctcctgtcgcctaaggccgcccgaaagcagctaactgacctctaaagcccctagacccccctgcccccttgccgcccaggcaggcccgcccccaccgcttgcccgctctgcgattggctgcgccagccgctgggcggggccttccggcgtgctgactcctggcatgtggagcagctcagtccccttgcctcagtggaaccgggggaggggagctgggggctacgaagagaagggtcggaggcctccctggagggttcggatcaactaagtaccctatttaatgccctgggcaggtggtttatgaaaagaaatttacgggagccctgtgtgcattttcagcctaaccctgcttttcccttaggcctagaatgtttgattaaaatctcctgcagggcagagagccagaggactctaatccagtggttcctgtttagtccacagcaaaggtgcggccggttggaagaacgcacagcctgcaagcagaagccttatctcccaattaagggtgtagaagaatctgggcgtgttgctggtggctcatgcctgtaatcccagcactttgggaggctgaggcaggcagatcacttgagcccagtaattcgagaacagcgtgggcaccctggcgaaaccccttctctactgaaaatacaaaaattagccgcgtgtggtggcccgcgcctggggtcccagctagtcgggaggctgaggcaccagcatcgcccagcccggaaggttgaggctatagtgagccgagatcgcaccactgcactccagcctgggcgagaggagaccctgtctcaaaaacaaaaaaacagcagacaaaaaaacaactggtaggaaaacgcaccctcaaaacacatgatgagatggtcgagactagaccctaggagggtggggactggctgggtgggtatccagagaccatgggcgtttcataatgcattgtttccagtctcctccactcagcgactcttcttcccctgaagtcttgcattaagtaagtgaatgaatcaatcatcaagttaatgaagctctgactttgtacttgtcctttgcttggtacagttgggcactgccttagaaacaatctccaggtaattttcccaactgcttttgtgaggcccagttttccattttaaaatctaagattacctcagtaatcttgcttttacagcaaatgggcatggagcctgacagatatatttaaactaagttatggacaagctgcccggtgcattaggtagcataggagctaaccttgtgggacatctccccatattcgtaatattcacccctacatctataatcaataaatgcttgtttggaggccatagaaactcttactgagatctgacctgtgtcttctgctatctgcctgatttctccccatagaacaggaaaacaccgtgtaggagatattgtgaatagaaatatgaatataggccgggcgtggtggctcacaccagtaatcccagcactttgggaggccaaggcgggtggatcacctgaggtcaggagtttgagaccagcttggccaacatggcaaaaccccgtctctactaaaaatacaaaaattagccacgcgtggtggctggcgcctgtaatcctagctactcaggaggctgaggtaggagaattgcttgaacccagggaggcagaagttgcagtgagtgagttggcaccattgcactccagcctgggcaacagagtgagactctgtctcaaaaaaaaaaaaaaattacaaaaattagccaggcatggtggtggatgcctgtaatcccagctactcaggagcctgaggcagggacaacggctcaaacctgggaggcagaggttgcagtgaaccgagatcgcaccactgcgctccagcctgagagacatagcgagactccatctcaaaaaaaaaaaaaaaaaaaaaaagaatataaatagaaaatacagtgattcaaataagcaattgttagttcctcagatcagaactgtgagttctatactagactcttacatgttatttcttctggtgtcttagcaatgattctgaataaagatcagactccttagtcagcaggtgggacagttctcaataacagaagctgggttctcaggggatcccgtggatatgaggatgaaggttagaagcacttgggaccatacctgcaggtctgatttgaggacaatgagaccaagacaggaaggcagcacctgctgaggggctgggggtgggagaagggaggaaacaggacacaagaaaataagtataaaccaccagactgcagtcagtgatcaacaaaattcccaagtttatattgagaagatttccctggtttggggttttgaagagattatataagggactcgggttgcttgatttttctcattctttttcttttaacttggtctcaatttttttgtaaaaaaaaaaaaaaaagaatgtcttatgtgcgcctttagaactggtgaatgaatgaacctccctttttaaataactgagattgtcactgaagcactgtcatccgatttaggcttaaaaatctgacactgaatttatcctaggtgataaagtgcaagtctcttgtctcctagaaatgatcaggcaaggaaacacccaggaggcccagggcaaaatgccctcctggaagctggtggggtaggaagatgctgaggcccagtatggtccctggagcatgcattctgtgtggtgacagaaattgtttgcttgaccatacattagtcaggcttctgaaccttctgataaacgcatctgtgcactttttgtaaaattcagttttagcaaattaccctgctaagtcagtttagctggcaggaatccccgtccaccatatactgatcagggtcctcatcccccaccatcccgcagctgatgtcagataaccttggcctgtgctcagcgagaatctcgttaggtcagtttagccagaatcctcccttacccttgatgttccctcgtagtcatttcctatctgctaacccccatcctcctccttgactataattcccacttccttgtgctggattcagagttgagcacaattgctctctcccactgtaagaactacttgcagtgctcctagacctacatatgtgaacctgtttctttaacagtgactcacctgtctttttctcctttcaacttgatactagctgaggcttatccgcatcaaagtggagggactggccccgggggatcctcagggcttcaccttgatggcctgcaggctcacattccactttttctggtgccttctggctcccagagtccagtttgccaaacaagtgatggaggttggaaggagggatgaggtgacagaggtgaaggagggtaaattcttttctaagccctacttgcctgacatgcatttaggtttttagaaaggaacgtgaccccaccctttattttgtatctcccacttccatgaccagccttacctgtaaaaatggggcatagaagagcccccatctcctagggcagtggttttgagcagggggtcactgaccagtagcaccttcatctcttgggaacttgttaggaaattctggacttggggtggtagatcatgcctgtaattccagcactttgggaggccgaggctggcagaacacgaggtcaagagatcaagaccatcctggtcaacatggtgaaaccccgtctctactaaaaatacaaaaattagctgggcatggtggtgtgcgcctgtagtcccagctaatggggggccgaggcaggggaatcacttgaacctgggaggcggaggttgcagtgaaccaagatcataccattgcactccaacctgggtgacagagcaagactgtctcaaaaaaaaaaaaataataattcctggaaatggattagcttgctgacaagagttattccattgtgtgtttctacctgcaatacctgaggatgcccattttctcacgatttataaactaactcattttatagacgtaattttcatacatttgggggtatcattctaacttcattattattacttcaaggtgttattatctccccgtcatcatcatggtcattatcataactagttggtgctgacagtagtcaccctgcattgagaactcatgctccaggccctttccacatagacttgatttaattccattcactcctcacaacaatcgtctgaaagaaagactcactaagccattgtataattgaaacacaagaggtgagtgacttgtgtgcccttgggcaggtaatttaaacactctgtgcccccaagttccaatagataaatgtaaataataatatctttcttacctaatacatggggtcaacagttaaagtactgtacatttgtgaggtatttcatggcacctgtgaattgctcatgtgatgacatagtgtgcttccagtgtcagtgtgctgggaaggagacagaataggaagaagactgaaaagatgccgagtctagtgcagggtatcctggggaaaacacctcctgtttgtccaagagcgattggccacacattgaagacacactacctgcctgtgaactggggtggccctgttgaaatcttgtggaaagcttgagatgctccttagagggtgtttatccctcgagctggcacaaatgcagtttgttgttcagtttttccttctactctgcctctatctggtacaaaatggaattgaagagtatataaaccagcaaggaacaatctgaaatcagaatggtgacaatggaagaaagtaatcttggttcaacccaatgttcacctgaagtctctttattaaagactactaacaggaacaaaattgcataataatcttcctatgataatttcaagttccagaatttctctacggaactttcaaatttcacctctgttaactcatggaattttccctagaatctgcaaattaccgaagtctttggaggtttgatgatcactcactggtcagcggtactataaaaggattctggggagtttgactcagtggtcagcaaaggctcttccgaatcttcagtctgattctgagattccccggggagaactggaggctttcttaacagctcttgattggaaagaccacctgcttcatcctctattgcaacagaaatagccattgtgaagctccatggggaggcacaatgagtttttcctagcatgtgtgactcaggtcattttgttctgtggtttccagttgtggggacttggcaaggtcacaccctcccctgagcctcagtttcatcactcagaaaatgaggataacaattctacttgcctcataggattgttgtgaagattaaatgagacatgtaaacatttgcttatagtaatttcacaccactttattgtggaatcaaagacagaattcttacagaggtcttggttagttaagaaaacatccattcaaagatttgattcacaggacaccctcactgtctttctctttttttttttttttttttttttgagacagggtctcacttcgttgcccaggctggaatgcagtggtgtgatctcagctcactgcaacctctgcctcccaggctcaagagattctcccacctcagcctccaagtagctgggattacagccatgcactgccacccctggttaatttttgtatattttttagagacggggttttgtcatggtgcccaggttggtcttgaactcctgggctcaagcaatccacctgcctcagccacccaaagtactgggattacaggcgtgagtcaccacacctggcccttgcttactttcgtacttcccatgaggcaggttaccaaattggtgaaattaaccataacgtcattgtggtgggcaagcagatatattaaaagcaaagatacagcaggttaacattaaattttgctcatcccaggacaaacctggccacaggaggcctttgccagtattctgaaaagtgttgtgaccatctcctttaaagctcagttaaaggtttctggctggactccaggctgcttcaagctctttgcttgtctttatcattctttaaggagggacccagacacagtgtgcagaggcctgaatcctccagaccattctctctccaccatgagtcctgccgtggggacctttccggctccctttggccttatgagccagaaaatcaggctagagcctaaagagaacagaaatttcataatcaggcctgttctgtgactgtatgggggagctgaaggacacaatgggctttctatattggagactacccatcatactctctctgaccagggagaaaggacagatgctgtgtgattttgcagtctgtgatttggcttcttattctcgctgctctctacacctcattatttacttcactcccctgaaaaaaatgctccctaacaggctcagtacccaacttctgggtattgctgcccacatttgccttggttctaccttttcagattgcaggatcctgaggttttgcttggagcaactcagattctccactagatctaagatctcacctagtcctgaggatttccttaaagggaaggggaaattagatagatagatagatagatagatagatagatagatagatagacagacagatagttgctgcctttgctctacagcatctgcttggtgaagaggctcaggatctggatcctggcctctcagctctcaggaaccccattcccccctgacaggggtggcaagttcatcctattattcattaagaaatttgaaaacaatcattcaggaattttaggtcaagagctggaaaaccccaagcctccgtcacctgagcaaagggagatactgtgagaacctgcaggatacacccatgttccaccacctgcccgaagaagcctgtggttcttgtcagcttctcaagggtgaagcgcagatcattttctgcttgagcagaagagcagaccaaagagctcattgactcaaggagcatcacggcaactgagctgcacctggaagagaagaatccagggtgtgatccatagccaaggcctgaagcaatggggcccatacttggcctctccagggtgagttgtgacccaagtgctgggctttagcccatgagtggtccctcttgccattttgtttcctcccaaagagaagccagtgttggtgatttcatttctcataatctccttaggagcacaggttttggtttgtgccttttttggatcaggttccctgcattgcagctgctataattaaaactattaacaacaacacagcaccacagaagcaagttagttgctaatggaatttgctgataatgctatcttctagagaccactctagtaactggagagccttggtgtagagctgatgataaaacctgttcctgcttttgtcagccatgaggagcatttcctttctagacagaggaactgaaacccacatgccagcccaaatttaccaaaagcagtcactggaatactcatcacaccatcatgtctcatcttatccctttcgttaccttcaaatacggccccatttcctcaggaccagaactcccttatgtgggcagcaggactaaggcccttgagttacctgtagtgactcctcatcaaatggaggaatgtgccagtattttcggcaaaacatgaatctgatgaaacactgactgaactgtctcctagtttcaaaacaaattattaccacttagggcctctatttagggcaatcagagtcagaagtgggaacgcatcttgtcctcctaccttgattaacagtaactctagttgcaggatgatggtcaaatcctctctcctctaatgtgcagttgtgaaggatttaggctccactgctcctgcatttgggtggggcctgaatcactttcagtctagcacaggcgggtcacttcaggccttcccacctccatcagcatccttcaatcctcccctgacatctctcatttatgcttcctattgattcagagatcccatcccgagtggctaaaagaaacattcattaacctttctacaaagtcatgaataatccatggattacattgaattcatccctactaaaaccatcttcagaaattcagatgtagtaaccttctttctgaatttttttttttttttttttttgagatggagtcttgctctgtcacccaggctggagtgcagtggcatgatctcagctcactgcaagctccacctcctgggttcatgacattctcctgcctcagcctcccaagtagctgggactacaggcacctgccaccatgcccggctaattttttgtattttgtttagtagagacggggtttcactgtgttagccaggatgatctcgatctcctgacctcatgatccgcccacctcggcctcccaaagtgctgggattacaggcgtaagctaccatgcccagccaagtattctattcttaatgaacacatatatgcataatatatctattttttataatatatatatttagaattgaatgtcagagtacatatcagtgttggaggaagggaataaggaggaagcacagaaagtaaaaaggaaaaataggcaccaaaaaagatttggagaatggcagatggccaaggagatgcagctgggaagtgcctcttccatggagaggaacataatatctagtaaaccttcacattttaaacagatcttttgagagaaaacactgaaagttgacacagaggtgacacagacaccatggttgaagagggaagaaatggggcagtctgctcagagtcactagacaccaggactggcccatataccctgaacaaacccaaggaaggggtgagtgaagaaaccctgggacactacatacccataatgtatctctgagatcctagttacaggagtttctacgaccctcatagatctttggactggtaggagagctgcctcgagcacatgcagaggcacagtttgaacccacacagagcccagaaggctttgttgtgctgtgcagctgcagcaaaatgcaaccctaggtgcccatcccacaagtctccatttcatactgagtggctaagttcctgctgtctgccaggctgggagtgaaccacgcctggccggctcacatgcccaagataggccccatcaccaatgctgtgtgattaagttgcatctggtccacatgcccccttgcctgtcaaccccttcccagacctcatgcctggtcacgcctgcaagagggtgtccacagcacagcatccactgcatagcttgagtgttttgttgacagcctgggaaaagctcaccaccctgtccccaaatcacagccagtgcttgaagcttagaggccagaggacaaatccgtgagcccagtcccaactccccaagactcaagtataccacccagggacattgagctgagatttgtaacctaatctcaagtgaaggaggatcctccatagtcagaatgcagagaagggtgtggtatgggttctcatgggggcatgggagctggacgcccctccctttgcaagaccagaccatgaagggtatggcctgatggtggtagcttctttcccagggagtgtccttgcacagaatgcctggagcagctcaacaatgtgggagcagatagcttggggaaagcctagttggttgggcttgccgccagggcgagtgtctgtgggagatctgctgggtcaggggagtgtaagctaggcagactccatggttgcctgctgggctgaaaatcatgggctgcagactccatactggtgttgcacccattgtgccactgccctgcctggagatcctctacccttgaaatactgcatcatcagagcaactgcagacataccctaaaacctgctctgactttggtaagcacagtggactggtgggtctctggagagttgtgtgtccctagagatgtaatcctcagtgtggaccatccctaggggaagggggagtgcagcctgccaaagcacaacatgagacaaagaaaatgcgaccatggcataagccactgaaaggagcaccaccaaggcccagaaccagacttggagaaggaattatgtctcacctccatctcccctccccagtgcactgttgcagatgcaaaaatagctcttcccataggggcccagaaagcatgcactgaaagaagttgtttctcatgattctccagtgagggcaagcatgcaccaagaccccacctgccagctcttactcttaagtccatctaccagattgaagtttgagttataccatcatataaaaatacattgctaaaacaagcaacatctgtgaaagccactgcagcaacctatctgtaaccaaggaacatatatggaaacttcaccgtctgcaactacccagaaatgaagccaatcaatcacatacaccacagtcatactttcaaagagaataaaaaatataaaagccctgtgatggttaatactgagtgtcaacttgattgtattaaagggtgcaaaatattgttcccgggtgtgtttggagggtgttgccaaaggagattaacatttgagtctggactaggagaggcagaaccaccctcaatctgggtgggcaccatctaatcagctgccagcatggctaggacaaagcaggcaggagaaggcagaagagcagacttgctgagtctcctggctttcatctttatcctgtgctggatgcttccagttcttcagcttttggactcttggacttacaccagtggtttgccaggggctctcgggccttcagccacagactgaaggctgcactgtcagcttccctacttttgaggttttgggactcgaactggcttccctgctcctcagcttgcagatggcttattgtgggactttaccttgtgatcatgtgagtcaatgatccttaataaactccccttcaaatgtacatctatcctattacttcggtacctatagagaactctgactaatacaaaccccatctaaatgaatcaaattcaaaaaagaagtgtcaactcccgcagatggaaaggaataagcacaagaagtctggcaatacacagagccagagtgttttgtgatctccaaagcctctcactagctccctaggaaaggatcctgaccagatgtaaatgtctgaaatgagacacatagaactcagaagatggatgtcaaggaaagtcaatgagacataagacaaaatagaaatccaatgcaaagaaaccagaaaaacagtccaagatttgaaagacaacatagttatattaagaaagagccaaactgaagttctggaactgaaaaattcactaaataaatttcaaaatatagttgggagacttaaaaacagactaggccaagcagaaggaaacatttcaaagcttgaagactgattcttcaaattaacccagtcatgcaaaaataaagaaaaaatattttttaaaaagacaaagccttcaagaaatatgggatcatgtaaagaaaccaattctaccacgtattggtattcctgagaggaaagaaagagtaaccaacttggaaaacatatctgaggaaaaaattcaagaaaatattctcaattttgctagagatgttgacatgcatacaccagaaatccagagaacccctgttatatactataaagacagccatccccaagacacatagtcgttagactatctaaagttaacacaaaagaaaaaacaaatctcagacacagctagagaaaagagcaacactacctacaaagggaacccatcagactaacagtggacttctcagaagaaaccttacaatccagcagagattagaggtctatttttagtactctaaaaggaatgacattccagcataaacattcatattcttcaaaactaagcttcataaacgaaggagaaattgagtctttctgagtcaagcaatcggtaagggaatttatcaccaccagactagccctgcagaaatgcttaagggagttctaaatgtggacatgaaagaacaatacacagaaaaagcacagttaagtacatagtccacagactctataaagcaactacacaattgagactgcaaagaaactagctaacaaaactatgacaggaacacaatctcacatatcaatgttaaccttgaacataaatggcctaaatcctccacttaaaagacatagagtggcaaattggaataaaaaaatcagaatcacccatctgctgtcttcaagagacccatctcacaagtaatgacactcatgggttcaaagtaaagggatagagaaagattaatcatgcaaatggaaaacaaaaaagagcaggagtttctattctcatgtcagagaaaacagatcttcagccaaaaacagaaacaaggacaaaaaaagttattgcataatgacaaagggctcaattcaataagaataattaactatcttaaataaatatgcacccaacattaattggagcatcacgatacataaagaaatcactactagacctaagaggtagacagcccctcagtaataactgggaacttcaacactccactgacagtggtagatagattattgaggcagaaatctaaacaaataaattctggacttaaatttgccacttgaccaattgaacctaatagacatctacagaatactctacccaacaaccacaatatacatatatatttcccatcttcacatggaacatactctaagagtgatcacatatgcagttataaagcaagtgtcaagaaataaaaaaaatcagataatatcaagcatcttcttggaccgcagtagaataaaaatagaaatcaatagcaagaggaactctaaaacacagacacgcacacacaaacacacacggaaactaaagaaattactcttgaatgacttttgtttgggtaaacaataaaattaaagcagaaatccaagaattttttaaacaaatgaaaatagagacacaatgaacaaaaacctctgggatgcaataatggcagtttaaaaaggaaagattatagtgctaaatacctacatcaaaaagatagaaatatctcaaattaacaacctaacattgcacctaaagcaagtagtaaaacaagaaaaaaaactatatccaaatatagcataagaaaagaaataacaaaaataagaacaggactgaataaaattgagactcaaaaatccacacaaaggatcaacaaaatgaaaagttggttctttgaaagtgtaaacaaaattgatagactgcaagcaagattaacaaaaaagatccaaataagcacaatcagccataacaaaggcgacattcactcgagtcccacagagattcaaaagattctcagagactactatgaacatttctatgtgcacaactagataatctagaagaaatgaatacattcctggaaacacacaacctcccaagattgaaccaggaagaacctgaaacactgaacagaccaacaatgaattacagaatgaattgaataagtaatagaagcctgggactagatgaattcatagctgaattctaccagacacacaaaggggagctcatgccaatcctactgaaactattccaaaaaatcgaggacgagagattctcctctgacttactctacaaaacctatatcatcatgataccaaaatatggcaaatactcacacaaaaaacaaaaccctaggccaatatatctgatgaacatagttgaaaaaaatcctcaacaaagtacttgcaaaccacattcagcagcacatcaaaaagataatacaatatcaagtgaactttattcctgggatgtaagggttgttcaaatatatacaaatcagttaatgtgattcaccacataaacagaatttaaaatgaaaaaaaaaaacataagattatctccacagatgcaggtaaaacatttgataaactccaacatgccttcataattaaaaccctcaatagactaggcattcaaagaacatacctaaaataataagaaccatctattgacaaacctagtctacattatactaaacaggcaaaagttggaagaattcccataagaacaagaacaatacaagaatatccactttcaccattcttattcaacttagtactggaagccctagccagaatgatcagacaaaagcaagaaacaaaaggaatccaaataggaaaagaggaaattaaattttatttcttcactgatgataggattctatacctagaaaaccctaatgattctgaccaaagactcctagagttgattaaaaatttcagtaaagttttaagataagaaatcaatatacaaaaagcagtagtatttctatacaatgcaatattcaaactgagaaccaaatcaagaacacaatcccatttacaagagccacagaaaaaaaaaaagaaatacttaggaatacctctatccaaggaggtaaaagatctctttaagtagaactacaaaacactgctgaatgaaatcatagatgacacaaacaaatggaaaaatattacatgcttatggattggaagaatcaacatcattaaaatgtctttactgcccaaagcaatctacaaattcagtgcagttcctatcaaactgccaaagttatttttacacagaattagaaaatcaattctaaaatttgtatttaactaaaaaagagcctgaatagccaaagcaatcttaagctaaaagaacaaaggcaggggcaacacattacctgacttcaaactatactacgaggctacaataaccaaaatagcatggtttgggtacaaaaatagacacatagaccaatggaacaaaatagagaatccagaaatgaagtcccatacctacaaccaactgatctttaacaaaattgataaaaatacaatggggcaaggataccctattcaattaatggtgctgggaaaactggctaaccatattcggaagaatgaaattagactcctgtctctcaccatataaaaaaattaactcaagattgattaaagacttaaatgtaaaactttaaactataagaagcctagaattagacctaagaagctcttttggatattggcctatgcaaagaatttatgactaagtactaaaacacaaaagcaacaaaaacaaaagttgacaagtgagaccaaattaaactaaagagcttctgcacacttgcatgttatattgcaaatatgaaatagcaaagacatggaatcaacattggtttccaacaatggtggattggataaagaaactatgatgcatatacaccatggaatactatgtagccagaagaaagaatgaaatcctttcctttgcagtaacatagatgtgcctggatgccatcatcctaaatgaattaagatgtaaacagaaaaccaaataccgcatgtcctcacttataggtgagagctaaactttgggtacacaggagcaaaaggatggaaataacagacactggggcctccaaaacaggggaaggaaggagggcaaggtttgaaaagctacttattgggtactatgtttactattcagataataagttcaatagaagcccaaacctcagcatcatgcaatatgttcatgtaacaaatgtacacatgcatgcttaatctaaaataaaaattaaataatcaaataaaatgatttccatgaataaaatggtagatatgattatgtggaaaatgctttactatttattatgtggtgaataatttaataatatttaataaatacatgaatgaaaaatagctacaactgtgtgttaggatttcaataattttttatttcattcctaataacttttatgtattattatatacataataatatatatagttaataataacaaaaacaacatggtattgaaataatttccacccagacggaggatcaacatatttaagtgattacactactcaagataaaaatcatttatcaaacagatcaaagtcatttacctgctttcctttttataggtcctaggaacacacgtgccacagacaataaaacatcacttcccccatcccactactttggactttatttaacatctttgggtagaacagaaactgttgataaggtgagttttgttttatagacaagagaggaaaatggatactttgtgtggtctgggccttagaaacagactaagatctttttttttctattttgctttttttactaggataaaatattaattggcaaaacatcgaatacaagcttcactatcataaaatcaaaacatttaagcaatattccaaaaaagatttgacaaaaactagacaccaagagtacaaaaattacacatcaacacaaagcataaaaaatgtgaactttcaaattaaacagtcaaaaacatgtacctgcatgatcacctccacaccttgactgccttcgtctgcagcacgctgctggtaaaggctgggtggctgcaccgtcgtcccctaacctaacattgctttcatctgtgaaaattcgcttgatagccaattaagccatggaggctattacatttacacggaggctacgcacaatctcaggggaggctcaaacagcagttcgttcctcacacgcactgttgggtgcaaagggcacctggagagtgagggagacctgggcgctttcctgcggggccttggccacgcggccgtcgcccgcaccctgtcccttgcctggcaggggacacaatatttgtacagattatggtataatttgaacgatttcctaatctacttatcttaatttatatagtttatttaaatgtcaaggcagagaaatacattgctcatgttaaggtcacgtgatgtggtggcgcagtaatgacttcctgaggaaacagagaaattggatgttttgtgatttagctatgtgcactaaacttattttccatgttttgagagcacattaaacattcacgtacaatgtgggaataggctggctcgtaaccaaaacgtccaacccagtgccaccctttgaatcgctgcgaacaccatcctattgcggttcagagaaaacaagcaaggctgcgaagcccgggggttcaggcagctgcagcgcttgggccaaggtagctccgctctctggtctgaagccacgtggccccaccccggggcggcctggcttttttatattgcttattgctgtgtttggcatgccattcaacccatcgggatgttggatagtgacttgagagcaatacctagatttgccctgtcgggatgttgcatactgagctcggaataagccctgctcaattgaggcactatcactaggaggaggcactgattcccgcctttcaatgctgtctattggtgaaagaggagttggatggcatctgggaaattagtatcacttctactttttcttcttttcttttaaaggttaaaaataccttgtattagttaatactgctataaaatatgaatatccaaatctctgtggctcagtaaaatagatttttttttcactcagagaaagttcaggtccacccttagtaacccaggctgacagagactcttccattttctatacatagcttccccaattgcccagagaagagtggaaagattttataggtgactgtacacaagaataagaacttagtacctagtcactaatttactcgttgaataaacatttatggagcttaacatattaatcactaggcagacgctgggacacaagaaaaatctttaagatatgtcactgcttattaccaataatgttctagtgagtaacgagagttaataatacgactaattatagtattgtaaatataattacagttccaataagacatacacacacagagaacaattttatctggtggttgaggaaatctttattgatttaagatatcttttgatgaacaggatttttcaataactatcagaaaaagaatgtctatgacttatttttaaaaatgattttcttatctgccttgcatatctgacactttcatctcctatcttccttgaatacaatatagaacctgacatttctttcctttcaaagatccttagagcatttcctacatttaatctgaatgtctttctcagtaatttttcctatacaagcaattatggctacattttcttaatataatcatgaaaaggtgagcaaaactgaaaatttaatttggagaatagatacgaaacatattcaattaattcaagttgttgttaggctgcatatgttcagctttcagtgaagatgaacaaatgatgataaatgagaaactgaaagaaaacaaaccaataggtgttttttaagaaacaatattattaaagtgcatgtgttttctactgaatgaaagcaacatagaccttttcctcacattggtagttagtaagatatataaaaacaactttgtaaagaacaattaatacaggttaatgaatcattgtgaaaaggggataacacactttattctaggaatgatctgcaaggtgttaaaagttaaaaaagatgaagaacaattgagtagttatttgatcatagtgtttattaaattgcttttcctgtatctggaaagctttacagaaatgtcttcaacagaataactgtgttaaaagccaaatgaaatgcattatgaaatatgattcttcacttggtgtgcaggtataatctcaggtgtaattcacacaaagagacaaattcaattttaaagttccatttgttacaatttgatgattgtgattaaagaaccataaaaattttatctttgacatttcattttttcctcacaaaagcattctactgtaattttcttagttttctttcctcttaactgtggtgttacctataaatgctggatttctctgttttacgtgcaacaaatctacaatcaactatttctggaacaccacttcatcttaacaacaaggacccataaatattttaaaaattcaaaatgttatatataaaacgctaaatgatacacataatacatttctaagtagtaattatgattatgcccataattatacccataatttaaaaatatgttacctgaagtaaattattatacattttatgttggaagtgttcatttatctttgatctctgttaacacattgtactatgtggtaataatataaactgccttactggatagtgatgtatctttggtttcatattgttactggactaatattccaacactatagatagtgaaatttaacattgaaacaatttgataatgccatcaatgaatccagtttttaagaatgggatccattttctaaaattgagtatatagatacttcatgagatatcttatcatgcatcctaaaccaaaccaacctcttcccctgactgtcttacagtgtattattattttatccaccgcagcaactagtacatttttcagaacctagtagatattcagtcattgtctatggaatacatgaacacattctgaatttggacagtcatcattcttggtgttttaaaacaaacacttcctgaattgcatccactattttctaagaagccctaggaattcattgaaggagggtatgggtaagttgggggtgaaactgtaaagatgtaggtcctcctcccaaaacttcttcagcgtatcttcattgctgtttgtttgtttgcttgcttgcttattttaaaagagatctagatatagtctaataagaattgcataaatgtgatgttccacaatgattctaacttacatggtgcaaaataataaaatattacattctagctgtttgtagaaaaccatggatactataaaggatctagattttctctctcctttcctcctaagatttattcactcagcaaagacttacctggtgactacttagtgctagacactgttttagatacttgggctataacagtgaaaagaacagtaattgaattaacgaaaagttcattttaattagctgtatggtaaaataggaaactaacaaaaataaaatataacatgtcaaatggcaatgactgctctgagaaaaataaaggagaataagaggttctaaattattatatatggccaatattaccaacatattatagaaagcaatgagttcataatgtttatcagagaattccatgaaaatcgctaaatttttctagaaagccaggcactgataagagaataaacaaacagataaccgattttaatttgatcttctcttacaggtgcagctatgatctgccattgtatataatataaaattaaaaattgtttatatttcattcacgttagcatataatgttcttacttttttttttttttgagacggagtcttgctctgtcacctaggctgaagcacagtggcacagtctcagctcactacaacctccacttcctgggttcaagtgattctcctgctccagcctcccaagtagctgggactacaggcaggcaacaccacgcctggccaatttttgtattttattagagacggggtttcaccaaattggccaggctggttttgaactcctgacctcagatgatctgcctgtgcctcggactccaatagtgctgggattacaggcgtgagccacagtgcccggccaacatttttacatttaaatatcagacatctatcagattcctttctccctactacaaacattgtatgcttttcgataggcataagattttgttttcattcaggttggattcaacaagtattatttagcagttcattgcatctatccatttacccaatagaggaagtatacaagatacaaatgaataaagtgtaataattcttatactatttgcccttatgtcatgtaactgctccatgtttgtattccgaaaacctaactgggagggaaaactcagaaaaatagaataaaaagtattatatatctcatacatcctcattttagaatattctaggggtacagatcagtataaataaaatactctggtaagtgcccaccacatcatctgtttgtcattcttagacccagagtataccattcttttaagaaagaaaacttgctactgtacctcctacccagtaacatatatatcacatatcatatatatatcataacatatatatcatatatcatatatacacatatcatatatctcatatatataacatatttgctactggttaggagtaacactcagaaaatcacacttaataatgtagtacaattaggtataaattcacttagtatttttaaattttacgtgtattcctatttatatgaatggtcatttaaaatcacatctactgatcctgatagcattaaaggcataagaggtactgaggatattaatttaattttgtttacagctatgcacagatatttttagttcactcagatttaatccagtagtctattatttgattaattgtacagctatcaaatcattcaggactcccactgtttcaacaacgagtggaaaaatattttttcatttatgtttatatgcagctatttgtagtctaaattaatatcctagcaattgatggtgaaattaaaattatttctgtcagatatggtaatttgatgacagtggataagcatgggagtaaaagaaagttttggggaagaggggacagtttttgtttacttaatgattattccaaagatgttaagtaaacattctatagaatgctacagatagtggaatacagcattgaaacaatttaataatgtagtcattgagtccagtttttagaaatgggatctattttctaaaactgagcatacagacacttcatgagatgctttatcacgcatcctaaaccaaaccaaccccttcccttgactgtcttgcagtgcatagggcatctctacactctaggaaagaaattatcaatctgtttatatgccacttataaaatcatacttaatgtacgattaggcataaatttacttgcatttttaaattttgtaaaatgttaacggtaagtgttcttgaaaaatatttctgagaatattttccaaaaaatgaacaaattttaatacataagggacaatatctttgtagtgaattgattatcagagtgtaatgtggtatgttctgattatgttacataatattctgattagcagaaaattctgaataagtgaatttagcaaaatgtttagaggtcaagaaaactgttttagactgactatgttttctgacccaaatgtaagaaagaacccaataaaaagaggcagccagataatgctgttgtttgcaaacttaaacagaagcttgcatgtaatttatgactcaaagaaaaataaaaatagaagttatactttatttagaacttaatgacagtgaaaaattacacataaaaaggaagactgttgaatacagcaaaagctggaattatataagaaatataaacataaacacacaaaataagtgtaaattataatgaagtaaaaatatatcaaagagaaagaaggaagtagtacaataaaaaataaagctgattctttaaaaaccatagttaaatagacaaatttccagccagattgtttaccaagtaaagagaaaaagaaggagatagatcaaaagacacaagatggtgatgaaaagagggttagcacttataaacatagtagaaatttaagccataatgagcacaagaaagcattatcaacttacttttgaatatataaaataaagacacttaaaaaaactgaacaaaaatgacttactagttttaaaagaaaaaagaaaaaacatcaaacatctatccttccaaaagtatagacttcaaaagtatagtcccagatgggtgaacataaaccacactttaagcaagaactctccattataactgcttgcaattttagaggataccagccacactcctgaaccagagcttggcactggctattccctctggaacacccttttatttccttctctaagcaaagacatggaatcaacctaaatgcccatcagtggtctgctggataaagaaaatgtggtatataaacaccatggaatactatgcagccataaaaaaagaacaagatcttgttctttgcagggatgtggatctagttagagaccattatccttagcaaactaacacaggaacagaagatcaaacactgcatgttctcactcataggtgggagctaaatgattagaacacacggacacatagagtgggggacaacacacactggggctttttggagggtggagaactggaggagggagaagataaaaaagaataactagtggttactaggcttaatactggggtgatgaaataatctgtacaacaaaccaccatgatacaagtttacctatgtaatgaacctgcacttgtacccctgaacttaaaagttaaaaatgaatgaagcctgtcagaaccacccatttagcagtctaacattttccctagtattcccaaacccctttgcctagccaacattttccacagcactttttgtcttcaaactactggcctgaagcaatctggcttagctttctgagtagctggaattgcaggtgtaccagtgtgcccagccacagttttttcaagacctgtttaagataacaggttagagaaaatcaagataatattttgagggggaagaaggtaaaatcaattaagacagggtgcacagagtacttgaatggtacagataatgtttatcctttgtactaaatggtgtgtatgtgggaactgattatattattttgactgtttgtagtcatattatatacatatgtgtataaataaaaataaaagaaaaaatataagctaaatttatagatatattaattttatttaaatagaacaaagatatgccagtattcaaatgtctgcaatgattcttaaaatgcacagaacctgtgtttaggtacagtatcacactgttcatccaggcttcattcactcgaatctactcttatctaaaatttgtactgtaagtaaaattacattctgtatgacagaaagcaaattataatattagaacaacattatggaaaattggcataacattgtacaatcatccattactttattatttatcattttgcaactttttattatattagtaaaaaaagtctaactgtacttaatagctaatacatatgttatttgatatttttaaagaccattattaaaataataataatttgggggtgagaaggcctattgaaaaatgaccaacgtggaaatcataaataagtttgatgcaacaaatatttgtgagtcttatagttaaaaatgtaaaaattcattataaacaaagctaaaagacaataatatgcattgggaaatatttgcaacatttacttcaagggttgatgtccttaagagaatttttacaaattaataaacatttaaaaaggtgaggaatggcaatagctatgagagacaatttacaaaaacataaaaaatatgaaaactgtttaatctgtaagtacatcaataaaaattttattatagtagttatgttatctattaaattaggaaaggtcaatacaattggtaatcttccaagcaaatataggggagaagggctttctcatacacttataagaatattattttgttagaatgcaattaaataaacacttggtaaaaatctatatcctttgtccaaacaatttcagttctagacctctagaatccacatatacatatacatatatacatacatatacacacacacattcatacctatatattaacaactcaaatccagctccaactcttttgtaagtagtattttgtccaacaaataaatttatctcaaattcttcttgactttcctccattatagagccagcaattctacgtgtaactctacctctaattcctttatttgcatttatttctgctttcaaacccttatatgaggcaagtgggattaatttatttcattaccttaactagattcattgctttactttgtcaaactctgattgatttgctcaactcaatcttatgtgttcaagaacttaatgtggattcctgttccaccttatgaaagtcttttccaaaaacttgctaaattcttgactcaagacattccagtcagtaatgcatttctctcctcaaatacaatggaactgtgttctaataagtactcttcaacaatgtgcagttatttctccacaactatcaattcccctttaagcagaattttactaaaaatggctttatccttctggggataatcagtaaaatggcaattggtgggcgaattaaaaatatattaaaagcagatggcagaacatgagtgcagatttttactacaaagcttaggaaaagcaaaaggaacttgaatagagaaaatgcagaaaagccctcctttggctattaggacggagagagcagaagtatgtttagagcttcaaagagtctgactctttgcaactgtttatcttaggactttaaggaagtaaaaggtgcaagtgaaacactctggattataaaatagaatctgacacagaggattcaacccagttaatatgcatgttgctcacatggaaatgctgagaaatttttagcaaatagatagaaaatgacagatggtaggtatatagaaaataattgtaggaaaaaatgtaaaatgaagacgtatggtattccttttatattttattttgttaatatgttgcccatattgctttatttcaaagaatgcaaaaccaaaaaagtagttccttcctaacttcccctgcagccttgtcttgtggagcttgtattttacttcatgagaaatgccaaggagatgtcatttaagctgaaacctccagcagaattagccacaatatttgggaaaaagatgtttccagaaaaagaaagagctagtataaatgtccttaggcaagaaggagctcacgatgattgaggaacaacaacaaaaaagattatttcactcaagaaaagtgaattgggagtacagatataaatgatgaggtctgaatatgattcatggggcaggtcacactagggtgtttgggtgtggtctaaatgaatgcgcggcatgagttgttttaaggagaggagtgacatgatttgacaagttcttaagagatccctttgattactctggggagaatagaaataaagtagcagaaatgaaagcaaagggagatagtaggaaataattgcacatttataagcaagaaatgatgttggcttggactctggttatagcaacaaataaagaaaaaaggaaatactgagaaaagttgattggatttgctgacattctcaacataaatggaagtcagtatttttttctaataaatataatatgcataaatatttttaaatatttaattcttttaccactaatggggcacgagtagacttcagggaacatgccagtacagaaacatataaatgtgatcattggtagagataggaattaataggcatttgaatctctccctcaacctggaataccacaaataaagctctttgcttttcatgttgcattgttatcataccctatagttttctgccattttcagttacttaatattatgttttgcctcaatagattatagtgctttctcttgttgtgttatatttgcagcaattattagtgaagttttaaacttcaatatcacatctaaaacaaaacaaaattgttgcctactattttccattaaaacatgagaccactatgacaaaaaaagctaaacgtgtcatgaaatgacttacattggatgaaagtatatgcaatatattaagaaataatctctgactttgtagttttttatttgtagtttttactagaacatgaaatcaatatgtgaaccctggctggagtttgcatctaaatgtaataaaataaaagaaagtttaatattatcattgaagcattaatgtacattagcgagctggactatataaaataaactttattatatttagcatttgatttttatttatgtatattataaaatgaatatagtttatattataataaaaataaaagaagtagtatgttaactaattagtataagatgcctacaaactacatatctgcctaaatttttgacccatgaaacttcaatgatttgtgttaatgttaaggcctacatttatttatatatatatatatataattaggggaggaattgttaattctttcattttaaaaattttaactttgcagacaaagttgactatacctgtggcagaacactgcaacagctataaataaataaataaataaataaataacttttattttctgtggagctcccagaattatgaattattctgtagattgagatttgccaaggtccttttcttagagttgcaagagcataggagaaagtcaagggaaataataagcagcacttgatttcctttaccacagtggatgggcttctaaaaccaaattacctgactataaatccagatctatcttctgcaggctacgtgattgtggatgttacctcttctgtgcttcaatttcctcatctgtaaaatggaattatagcctaccctattttgtagtatagtgaggataaatagaatgaatgtatgtagttcttagaatagagcatggcacgtgataagtggtcaataaaatattgtttactactagttatgtaacagtcacttcacacataataatgatttaataaaggaataagaagaatgtagagcacagcttctcaacattggcactatgacattttgggtcagacaattatttaatgcagagggggctataggatgcttagcagtgtctctggccagtagcgtacctcctcctctccaagttttgacaactatcaaaaaggcttctagacattgacaactatcccctgaaaagtaaaattgtccctgcttgagaacacaaatataaagtaaccactcaaagattacattactaattttaattgaatttgaccagcattatgaaataagcataagcttaagtttctacccttgattttgtcattgtcagttagggcagcagagaactccaattctgaaaattctgaacatgtgctaataccctataatataatcaaaactttcatttttgaattgtatttcttaaaaattagaaaatttattaagcagcaacatggaataattaaccacaaaaatgttgaacataaatctcatttgcctaagttctcttttgaagtcctatttcactatataagtattatgtgttttgtttcacagctagataacagccagttttttctttgagcctaaggttgcttctcaaatttatggtggcttatagctcttctaagtttctataaaacttcagcaacctgcagcaggttgaaatttattgatattgagttattcaccaggtcatattacaaagtcagggattgactcacccaaaccagatgctccccctgccaccagatcactaggagatattgcaatcatttcccctggttactaaattagcaaaaattctcagggagagagaagggcaagatggcacagtttaatacttactattattcttttattctttaccatcattccctttgaatggattaagaatctgacataaatataacttgctaaagaaagggtgttaggtgagagggaagtcatattggtctaagaaaagtcttagagaaatattttgaaaagaggcagagagaagggttggattggagtgggtgggtggggaatcacactaaggagatggatcattcataatttctttagacatggtgaggcagccacaggagtctgaacttgttgaaaccctagtctgaagccaataaaagtgctcaataaggtcatactttgatcttctctgcctaaagcagttattcaccctatctttgggagaggaaacatctacaaacctttgttctctttgttagcagagggatgacatgaatttgggaaaaacgtttgagagacaaaatgagatttagctcgagcaagtgatcgacttgtgctgggttgcaaatggacttttccaacaggcagattgaaactgtgcttcagcaattaggataccagatataaacatccatgcacagaattggaaaggttcagctttcatggttgctatggtttgaatgttccctccaaaactcatgttgaaacttaatccaaaatatgacaatatagagaatgagctttttaaagaggggattggatcatgaaagttcttccctcatgagtggattaattcattgataagtcagtggattaataggttatcttgggagggaaaccgttggatttataagaaggggaagatagacctgagctagcatgttggcatactcagccctcttgccatatgataccctgtgctaccttgggactcttctgagagtccccacaagcaagaaggctctcaaaagatatgccccatcgaccttggatttccaagcctccttggctgtagaaaataaattcagttctttgtaaattactcagttttaggtatactgctataagcaacagaaaacggactaagacaatggtcttatccagaactttgtaaactagaattgcctgtttagattcagtatgtattttttttacagatgcaaagtaattttgttttgaactgtacaatgaaggagtgtcataagcttttccacatgtagaggctctaaatatcagtctggcattgtgataaagcagagagtttaaacccaatcctatttgtgccccatgaacgttctttctggttacagttcagaaaaataggaatggatgcgtaactcaaggagaagcatttaatacatgaggctttttctcaaaattttgatttagaaaatgaggtattttagtatgttaattataggcatttcaactgagaagtctaatagcattgggccagaattgttgcagcagtccaaagccatggataaacttaagttaaagggaacaaatactaacagccttccaaattaatctgtattggagaggatgataaacagatgaatgggaactagaaaccatgcagacttggaactagatataaaacaaacagctatctaatgattccttatttactctgagcccaagatattcttgtatccttttagttaaacctctgttttactaaggaaatttaaataagattctgtctcttgcaagaaaataacatctaagacatcttcgtatttaatactgccttaattttgtttacaccagtggtccccaacctctttggtaccagggattcgtttcgtggaagacaatatttccatggacagggttggggggaaggtttcgggataaaactgttccactactcagatcatcaagcactagattctcataaggatcaaactagatcacttgcatgcgcagttcacagtagagctggtgcttctgtgagaatcaaatgctgccaatgatctgataggaggcagagctcaggagtaatgctcactcatccacctctcccattctgctgtgtggcccagttcctaacaggcccagtaccagtttgtggcccgggggttgggacccctgttttacactataacatttccacacgtctctcatggcctttcagatccactgcttgtctcaactcaagtccggctacctgaaaattcgattattttttcaaagtgaatttgaatatctttatgttgaatacacagtctccacttttacgcagcccctactgtcttatatcatacctctctagccctggaagagatcaactttacattcacttttcctgttttagggctattattttatcttcaattatcaaaatctatctacatttagatactttaacttgcaaatacatagtaaacaattacggattatttaaaatagcagttttcccatgagtataaaaaaaaaagaacaataaaagcaatatttgttgagtattttaaagtgccaggcactgcgcagtgtgctttgcttaagtaaatgtttgacaaaataaaaggtcttttaaaagttccatgctttaacattaataaccatataaagataaggttagactttctatcaaattagcagttttgtgaagataggccttttctgctatatagaatctcctcaaacctgagtgttcgtattatggattatctagtatactccatagctatcaagtttgtgtgtgtatgtttctttctcaagcaagttatcttatttctccttatttcttcagacttatcctttcttttcttttcttttcttttttcttttttttttgagacggagttgcactcttgttgcctaggctggagtgcaatggcatgatctcggctcatcacaacctctgcctcccgggttcaagtgattctcctgcctcagcctcccgagtagctgggattacgggtatgtgccaccacgtccagctaattttgtatttttagtagagacggggtttctccatgttggtcaggctagtctcgaactccacccgcctcagcctcccaaagtgctgggattacaggcatgagccaccgagcctggcccctaacctctcatttctaaggaaatgacaaattaagtcttttatgaaaatacagtgtagggtcatttaaaaatattttttgtaataggtgtctctgtacataaatctatttaattttttctcttttacagtaaaaaggcaatactgtgttttagtttcaccaaaaatttcagtagaccaattgtgtaaagggatacatttatatgaatttttttgacatagtaaaaactaagaggggaagttattcaaatatttcagcataaattccctttccttgaaattgcaatcatcatgtgtagctacaattcctcagcattcctctgtagtttagatattcccaaatgtctgactaataactctatctataggcaactgttctgaaggtttaaagtaaggaggatggggttcatttagaaccagtgggaaaaaatgctaatgctgggctttgaattttatggatgctgtagctgttatttttcaattaaataaatgtttatatgccatgttttgtagctatcgcagttaaactgccctcatctttttgcccagcaaaaaacccattaagatcttcactgagattgagtctaggttttttataaaattaataactgtgctactggtttctcaaaaatgagtagaaatgacttttcaatgcaaatgccagtttttgatacagtgaaattatcctgtctgcagtgactatttgaacttttatcggcaatcggacactgagagacttagtatatgaacagatttatccttagattatctaatacatgctttgcaccctgcaccataaaacctgatctatttttaaagccttggttgttctgaaaaatgaaatgaaattgtattaaatggcattttgactggggagaaaaaaaaaacttcatgtggtttaagagaatggatgccggcaattgactgtctactgtttattcaaaacctatagattagcagccagatgtggcagaaattggctgatttttcattcacaacaaaaacgatgctgtgcttaatgaatggaggtttgttatcccagtaataagtaaaaggtacatgaaagcccttgtgtttaatgttcatgcaaataagctatttgcaggtggcttttgggcagggtcaaatattttcaaatatttttcaaaactgggtcaagttttttaattgtcaaaaattaccagctagaggaaaacctcctaaaaactttattatgctatttcccaagtaaatgaaatgacaagtcacttatcatttaataaattacatatgaaaattcttttccttatgatttcatcaataaataaattctagaggattctagatatatttatttggcttcttttttttaatgtggtatcaaattttgtggatattctttagagaatcaaattcttaaaatggcattgaacatttaatttaaaatgcccttcttgaaccatacatgtttattaaaaaattattttatataggttatccattaaaaaacaattttctatatatgtaaacatttatgataactgctcattattttggtccatacttatttatctacctatttattaaacaatacaaatcatacgctttgtaaaaataaaggcctagtctaatattactctctgtcagaaataaaataattcagagaagtctgtattacaagacaaaataaaacaaaatagaaaatgatgagaatcacaaaaccattgccaaatttccagctatgatatttactctccatgtggccttaggtatcttactctcttattttaacctttctttgattactgtaaaaataatttgttactaagaagccctcttgctttagtagctgtgagtataaaattaagaacataattctcaaaaagtgttttagtcttcctggaaacattttaaaatatcaattaatcattgaacaatatacaatcgcctgatcatttgctaagagagggttgcattctcatctctgttcacttctgtcctttctgagactcaaacaggtatgagagctagaaaaaatattaatgtgtagtaattcaaaatttctcattcatgaatctcttcagcagtgcaaagaatactttgtaatttttaaaaggcatttttattaatatacttctactattctaccccaatcaacagcaaatttacctaaatcatgagactactggtactgctaatttttagaaaagaatgacataagaactactattaaacccaatgaatcctttacctgaaatgagaatgtccacgagtcagctcttctgaccctctggccagtgttctggagttactgatctccaactttctaattgaactctagcttggtatgtgagagcagccatgggtgaaccagtggagcaagatttaagccttgacattgccattaatgattcaccacctgttgcaagttcaataagttatccacacaccaaattgtggtcgcagaattcagtgagataaactaagttagaaagatttggggtgaataaatgtttgctaaatcagaattgttaatgatagaaatctgtatcttaacaaagttgagaaatcttgtcttcttaacgtgtatttattgacttcccaggatatgtcttagtaaggaaacatagcttctggcatttattattagagtgataaggaataataaaccacagtgcttgagagacagggaaaggcagggggacctagagacacagtaacagaagcagattaattgactgatgaaataaacttgagatgagagagcacagaggaggttcaagagatggaaccatatattcctctctatctgctcccaccatcaagggaattaatagcatattttataatgaatccctgataaatattagtctataattgaaaatctattaaaatgactatttcttagggtacacaaaaatattacaacaaaacaagtaaagaaaagttgccatgggatggaatattatattttcctgcatgtctgcttcaaggcagaatcctaatggtcatgtaggtaggtaaattattctttttacagcaacttctgggaggtggtatttggtggcgcataaaaggcaaggggtgtagtgagggtaaagtgtaagtactttgatcttgagccttgactatattggacttgggatctcggaaatcttggggataaaccgtggattaaatccataaattagtagagtgttgattatacaacaggtagaactacgtgccacttttggagggatagtcttctttttttaaaaaaacaaaaggccttaaaggctttatatatatataaagcctttttaaattataataaatacatattttttaatgaaacaatctgcacatatacaattccactctcaagaaaggcaattatttacataattttgcagaaattcctataattatgaaaataattgcctttcttcagagtggagttgtatatgtgcagattgtttcattttaagaaaaaaaatatttattgatttgattaactgaagttctggacgcttaaaaaatgattaaaatacacagatctactatctgtcttcatgaactttaaatgtcttgtaagaaactcaagtaataaagactacaacatttattatttaactggaacatgtattatttattatcctaactgtggttaggaagcaccattatctattatatctaaattaatcaagttgtatcctgtaacaggtttcctgttatccactcatgtcttctaacttctgaagtattgtttaaattacaaaggagaaacctagacactacattttctaggatctcaggacaatagagctccaggtgaaattatgctaaataagggcatgagtgtaagatgtggatgtcacagtgaagagatttagagcatttttctggtgacctcctgtttaggtttgacaagcatctaaaatcattgttagcaactttcccataattattgcattttcagcctttatgaaaatagcagcattttttttcctttctttgcccatgcacaccatctaatcatgagataagtctccttctgagtccccaaatacatgacatacatagattgggatctttttctgacctgttcctgtctgatacattcttcaactctaagatgagttcatactcatcttctgaagcccctgggaaatggaaatattttttcatattagatgttggtagagacccatcatttaatgaacatctatgtgccaggaattgtacaaggcacttagatacattattcgtgtacctcacacaaatgtatcaacaacacaacaaaatgtctgtatgaaataataattattatatcccttatatggaaacagatccagagaggaagatacactagcatgtgtaaatagaggattcaagaattaaacatccatctgtccaactgactacaagctctttcataaaatgctaatttctctcctgcttctaattttcttatcaaaaattgtcatctattgttattgggtctatgggtgggtagtgactccttggtttccattttgttctagcggattactgtctttatttttgttctagtgtttattgagagtcctaattaattaacctggctgctctgacttccatcagctcaccattgtctcttcttccagctcataatttctgtaacagagctctaggctatgctaaagttctgctatatgctgccagtctctctagatccaagtgcctcttgtcggccaagtttatatgcacgtgtttaaaatcttcttattgactctatatacaaagtcttcacatgccttcctccttaaaataatagcattgtgagaagaaaaaaaaatcatcattctttttaaaactaattcaggatgtctatgtaatacaacaacaagatgtgggggaatatttacctggtagttctgtccctcattatcattctcactcattataaaattggtatctgaaaaaaatcttgctgcaaaaacaaaaaaaatgtatagggtataaagaaaaagtttgcttcacatcataaccattacccatcccattgccaaagggaagattgtacactacatgattccggggagcagcattcacatagactacagtgtgcatggtacatgcaagagaccccatagtactacccactttgtcctccttgtagacatgctcacagatgatccatgctccctgacctggagtagtcaaataaaagagtagcatcaatttattaacattctttccagaccattttctaggtattcccattatatattccttcaaatggaaggattttattctgtacatcgcatctcactgtacacatttttttctgaaatctgaaatctgagtattttaattttatgcagtttcaactgtgagaagtacctgacagactgacctgacctaactctctctaagctaaaacactcataaactagcacagaagctttacacatttatccatttctctaatttacttatctattttttcctgaaacatctattaatctggcagttatttgagatgactgtgagcttactatttgccagtgatggcatgagcaccttggtttagtctagtgcctggcatttattttcctaaattctggcagcaagtttagctgtaagcatattttttatcagaacaatcatccatctttaactacatgtgaggaaagtactttcttatattgcattacacatttttatatggccacagaaatccttacttaatctgacaaaattatggcagatttctttctcgtaaggtcaaggaaagaatcattctgtactgtttccatggagatgtttctccttttctcaattgccaattgtctactgtgtgtcctgggttccttcttttcatatgtcatgaggattctcaccccagcattctgctcctctgagtaaaagcccttgacttttcacttctcagttgttttgtttgtagttttcttgctttcctttatttttcttactctataaatgctacgaaagtgtatgtaaaaatttacccatcttttagtttatatttgttatcaccctttattcatataccaaaccatataggaaatgaatataaggagatcttccttagtaggaggtagaagtaaaattttgtttagaataaaaacagaaaaaaagagaacaaaattccatatcaccagtttgcttctaaatgcccaataagtttccacttatgagcttgctactgtacacaacgcaagggcttgtaaaaaattgtctaaatgatagtggttaaggacgtactttaggctaggttactttaaaaaaatatatcatcacttctgccgtcaaaagtgaatttgatgtatcataattgttaaagttgaggagggtcaaggattcctctcattctatggtttccttataaatacactttctaataaatgcctaatttttttctgtgaaattaaaccattagatattgctgaatgtctgtgtgtttcttacttttctagaatctcattcttaattatagttttatatttttccttcaacaaagtcttaaaacccatgcagctggtgtctattatttacattctgtgatgtattttatttgactttgtgtttttagtcttttcacagaaatccttttattgtgatcttcttttccaaaagcacttatttcatatcttttttccatacctatcttcattagcaggttgcatttcagtttcttcagtccttttttagataatatattttactacatctgccttcacaacactgtatatgctctgatgatcaggtctccctttttttttttttttttttcaattctcgtcctctttgggacccatgacaaagtaaaaggcagacttttttctcacctgacttaaaagtaaaaaggtggccgggctcagtggctgatgcctgtgatcccagcactttgggaggctgagaagggcggatcgcgaggtcaggagatcgagaccatcctggctaacatggtgaaacccggtctctactaaaaatacaaaaaaaaaattagccgggcatggtggcaggcgcctgtagtcccagctactctggaggctgaggcaggagaatggcgtgaacccgtgaggcagagcttgcagtgagccgagatcgcgccactgtactccagcctgggcgacagagtgagactccatctcaaaaaaaaaaaaaaaaaaaaaaaagtaaaaagcctcatatgtttctcctctgattcttcttaggcccagcatttccaaaaccaaaatagtacacagaacattagttgtaatgatacttcaaaaggttcaaatactagtttttggctgctttctgtctatatttttcttctagagaaattttctgttatgaagtattgaactattcagtatactttaatattttccaaataaagtttcaaaactgatatttaacaatattctcttatattcaaacatattctgaactattttctgctgtgaacctctgcctttctggttcaagcaattctcatgtttcagcctcccaagtaactggaattacacacacacgccacctcgcctggctaatttttgtatttttagtagagacacagtttcaccatgttggccaggctggtctctcaaactcctgacctcaagagagctgcctgccttggcctcccaaagtgctgggattacaagcgtgagccactgcacctagctggttatacatattttcaagtctattgatacctagtgccaggaacttgatttcaagaagaaatatatgttgtatgaatgcaagggctgtgtttgcttttgctcacctgcttctgcagtggccaggctttttgtcacattaaaggtactcagtaaaacatttgctcaatgaataaatgtatggcacctgccactgaaaattaagaatgtctccaaaatcagacaacatgacatgcgtatctcttttgggttgccagtgttgtaattctactcacaccagtggtagttcttctgaggcactaacaagtagtatttttctggtggttatgatctcactttccagcttctctcatgtatcagagatattttatagcagttgaaaatttgaactctcaaattagataagttgtaacttagagtcctccactaggtagctgtgtaaactcgggagtcatataacttctctgggcctcagttttcctccatgaaatgggaagattgacagcatccacttcaccgagaggttgtgaggattaaatgagctcattttcatagaaatgcattatggtgctgagcacatagtaattgttcaataaatgttttctgttatttgacataattgagaaactctgaaaatactttttcctccaaaagggagtatataaggaaagatgatgattctatgtaaacgtctcaaaaaagagccgagaagtacaaatgagaaaatacaattgagaaaacagaattttaaaagatttcataaccttttaaattcctccttggttgtttttattatcccaggcctatttctttctaataattggcagaaaaatcacagaccaaaggcctcctctggcaggggagcctggaagagcagctggggagattggcgtcctaccccactgccagtcttcccagggactgagagagggaacaggaaattggtgagtgtctgaaggtctacagtgagggggacagaagagagaatgcagggacaagtaatagactgataaaagactttgagacttgaagagtttccagtttggacgagctgctggcactgtgtgcctgggtcagtcacagtgggatatggatgctgactactgagtgaggatcgagtaggtgtgtgggcaagggcaggtcatgtcccactaaggactggcagaggctggcagtgctaggagaggaccagtcctgggggagggagagctagtgttgaaaacagggaccaaatcaagcctttgttttcccagatgtgctatattcagtcatttaatcgacagctgttcttgagagtctactatacgccaggtgctgatgcaggcccaggggtaacagcagtcaaccaagaaacaggcaaacatttcaccctttgtggagctgtgttctagtgggaggagatagacaatatacaataaatataaaacataccccagtgatatgtattagaacataataggtaccttttttaaaaaagagctgaataatgagggtggtgagggtgagtggtgaaggggaagtttgcaatattgattggggttaataagggtgggccttgttcaaacagtggcatgaaagccaagacatgacgcaggtaaacgagcaagctagagagtgttctaggcaaatgtaaaagcctcaaggtagaagtctgtctgtttttgaggaaggccagagtggctggagcagagtgagtgagggagaggatggtaggaaatcagggcagggagattaataggggaccggttagtagggaccccaggaggccactgtagtgttggatattcctggatcagagtttctcaaatcattctccacaggtaatgtctattctccaagagagttttccttggcctgtggccaggctgctcaaatagaatgcagaaacaaagaatttgcctgaattctgctagccactctccaaggtcttctcctgcgatgggtggagggactttcagggcaaccctgttctaagtaggaggtgaaggtgatatccagacaaatccttcctgggtatttgctcgggggaacttgggactttttggcagtattgtctaaggctctggctcattaattcagccctcgtgttcccgtatctgcaagggcataactgcagtcccctcagttctctgggtaatgtgactctcactgcaaacctcaacatggaaagctcttgctaaggtgggaaggtctcagtcctccaaaggaaacgaagttgtggcagcctttttactagaaggatcaacttagtaattaacaaaaatacttaaaataatgaagaggaggtgggtgtaatcaagaactatgattattcaggatctctgtaggagtaaatgtattacttcaaaattctccagttttgcacgcccatgtttattgcagcactattcacaatagccaagatttggaagcaacctaagtgtccatcaacagataaatggacaaaggaaaggttgtaaatacacagtggagtactattcagccataaaaaagaatgagatcctatcatttgcaacaacatggatggaactggagatcattatgttaagtgaactaaaccagacacagaaagacaaacgtcgcatgttctcacttatctgtgggagctaaaaattaaaacaattgaactcatagagatagagagttagaaggatggttaccagaggctaggaagagtaggagaagagtcgggggtacgtgggtgtggttgatgagtacaaacaatagttagaaaggatgaataagatatagtatttgctagcacaacagagtgactatagtcaaaaataattttattgtacatttttaaataattaaaagagtatacttgggttgtttgtaacacaacaaataaatgcttgaggtgatggataccccttttaccctgatgagattattatgcattacatgcctgtatcaaaatattacatgtaccccataaatatatacatctactatgtacccacaaaaattaaaaattaaaaaattaatctccagctttggagtcaaaagctaaagccatttttttacattttaagatttgggggatgaaaaatacagcattatgcttttaacagccctttacagctttaccattttttaacctttgtctcagccttcttgtgtttaagtataagtgttctctttatggaaacccaaagcttcccttatttaaatttcaaggatgttgaaacattgtaatgtttcattacaattaatgaaacattacattaaaatgtagagtctacatcatgtacctgttttctttttttttctttttttttttttttgagacagtgtctcactctgtcgcccaggctggagtgcagtggcgccatctcggctcactgcaagctccttcctcctcctgggttcatgccattctcctgcctcagcctcctgagtagctgcaactataggcacccaccaccacgcctagctaattttttgtatttttagtagagacgaggtttcaccgtgttagccaggatggtctcgatctcctgacctcatgatgtgcccacctcggcctcccaaagtgctgggattacaggcgtgagccaccgtgcctggccctgttttcttttttaaaaaatgttttatatttttaattacccttttaactgaacctgttttcaattcatgtgaatatacataaagtataacactaaagagttaaagaaaatatcaaaaaactctcccaagaggtgtcaactgagtaataacaacctagttggaattaagccactttgacaagctacactttctgagtgcttatgtaccaattgccttaacagacatttatttcttggtgtgacaggctgctgaccttagatcgtaagcccagccctgggtttccccttccagataaaactctgttatcagaccagagctggcttgctcagacacagtgccagcctacctgaccacaccctgccaacagcagctgctgaggagtaagactgaagttacccaaatgctcgtccaatgggctcacatgttaaagaccaaatattccccccggatcatgatctcctcagtcctctcatctccggaaatggagctaccatcctttcagttgttcaaactaaaaagctaggaatcgtgctttgattcatctccccccaaccatgtacatctaataatacagctaattccaacagctccttctccaaaagatgtcatgactctgtgagctaccttccatctctaccgccataatcctggtccacacttcatcacacctgacctcagttattgtgatagctttctgttttattttattatttgaattttattattttattttatatgagacatggtctcactctgctgctctggctggagtgcagtggtgcaatcatagctcactgcagtcttgaactcctgggctcaagcaatcctcctgccttaacctcctgagtagctgggactacaggcacatgccaccacacttggcttatgtttttattttttgtagcgatgaggtctcactgtgttgcccaggctggtcttgaactcctggcctcaagcaatcctcctgccttggccttccgaagtgctgagattacaggcatgatctaccatgcacggtcccatagctttctcagtgatcgccatattcccaaacttgcactttctaatggccgtcagaatggttcttagaaacctatatcagaccatttcacgcctctgtgtgaaatctcctatatctctcactgcagtaaaataaaacccaaattccttaccttggcctacgagactgttacttgaccagactcttacatacttttctgacttgaccttcatccctaaatgccacgctccagtcactctgggccttccttttgttttctgaacccattcaatttgttccagcctttgtataaggtgtctcctttccctggaacactccctccacccccttgtcttctcaaggctggatatgttattctgatctcatcttaaattaccacttcctcaaagaggtcctctgtgactccgcagtctaaagtagcccccaccaatccgtctctatcctattttaactttcaagaggatatttttcctctttatttctttttcctagctgtctcccacccagtgggagacactttcaatagcttgttagtaatctaatatttttttctgattgtaatagtagtgcatactcattgtaaagtatttggaaaatacagacgcaatagtgctttggctgggttagagtcccagaatgtgaactttatgagagcagcaattttgacatgcagttttctgctatatccccagcacctggaacagtgcttggcaagtgaaaggtgttccataaatagtcagtgcatgaataaagttttctcttggtggggttgatttctgagttggttccatcatgggttggttatctttatcttccactctagactgtcttccttcctgtccactcatctgataatctacatgccccattcatcactagggaacccgtcacaggaagggagtgggtgaactagcataagtggaatagctaaattgagaagactccaaaacttatgccttgctgcatacaaattgttagcaatatccttttgcttattagaatattctgaattaatatatagatgttctaacacaaattcatctcttttagcgctttgctatctctaaaatagagagggaagaagcattgttctatttctcactgaaaaaagagtattacagaaatgattttagaagttttaaaagtgctattgaaatgctattttaaatacagaaatgctattttaaacatggagaattaaagtccgagccatatcatctagcaatctaacaaaaggaaacgtaactttgggctttgaaaccagactatgaacagaggctagttctctattttaagcagtgtcttccatgagtgggtatttttatattgctatctcccccagtttcaatagcttattagtaatctaatattttttttctgattgtaatagtagtgcatactcattgtaaagtatttggaaaatacagacgcaatagtgctttggctgggttagagtttaagggtgtgtgttaaagcccggtagaggaacatgtggtgtgagacaacactgccccctagaggtccttgtgtgccgcggactgaccgggccacccaacctccggagacgtcccaccgcttcgagaaggctcctggacaacgaagcgcgtccggtgatttcaaggtggggctaggagtcttgtgagaggaaactcggtcctgaccctatgtgagtgctgaaattcatagaactgtgtagacaaaggtcaattttattgcatgctaatttaaaaacatttaaaaataaaataagctttaaatgcctttaagacataatttaaaataactttagaaaaattccagtgagagactcatcccataatttagccactccttctgatgctagactgctgcactgttcctatctctgtataaataaacctgtattggaaactctgggggcataaatctttgtacatatttaagattttaaaaattaggatacagctcagaagtggaattatggagaagatgagtataaatgttttttagaactcttgatatctgctgccaagttgctttcccttcaaggtcgtgtcaattgccgctcccaccagcagtgactgagattaaatggtttgggtattattgagtacatgaaattagaagacatattcagggttggttggggaattgcctcctggttgaggtggggtggcggagaagtaggagagaaacggaggtgggtgcgtgtgtaaaccaggagagaaataggccttcacgcctgagggttatctgcttcaggtttttgtgcttccccaataactcctattttgctccttaccactttctttaggattgatttttattttcttatttcttcttcaccctctcttctggctgtagtgtaggagcaaagttaggctaccaaagcagcaatactatcctatgtaatcaaccaagcaacgtttttaaaacaccaatcatatgaaaggcactgtgcaagccacccctgccctcagaatttacagtgcaacagggaaaggtgaggttagtgtgacttccctgcccaacaccacctttctccctcctaagttgctaatggtaatgatgaaaataatgtcatcatcaggtattatttagctattggaagaaaccactcagtgtcgagttcatcaaggaatccgtcacagatgtgaaatcaagccaggcctagcaaggatgagtgcatttaattgaatgcatttcaggtagagaaatgccatgtgcagaagtgacggcctttggtaaggagtatgggactgtgactatttccccttgatgaccttgcatgaaaataaacaaacagcatttgaaaaatctcctctcctgaggtgactagaaggtgactcaacagtccatttccatgcatcagcttgctggaggaaatggaaaggcctattccccaaagcagtgtttgtctcacagaaatagagatattatgtgtcataaattgggaaaacttgtgaaatgaaacatctgttctgcatgcttaagcaccaaggcacttgcaaaatacgaatttttactccatattccaaatgctgtgatgatgagctgagaatgagtttggaaggttcatctctttccaataaaaaggttcatcatgcctctctgacttttataattattttggaacattttagataggaaattgaaagaggagggaaagaatgatgacagaactgaagaagaattgatgaaagggtcaaaaagctaaagaactttgagaaatggattttatgtgcagtcaacaatgccttcagctaatttaaccaaatcaacaaagccattaaaatgtataatgatttttattttgctacaaatctatgtagaatgaaagataccttgtgaaatgcaaaatcttccatatttgggatctaagcacctgcatagatgtttgagaaaacggaaggtggctattcttttattgaatgcttttagaacataatgctactcccccctgctcactccaccgcaataaacactttattcactctggatgccctcaatttcccctaccagctaggagctgtgtatcactctccaatgtactgttgattttcaatctagaccagtctccaaggttactcttgactttaaaatacacaacaccaatttgcaggttccaccagatatccaggtgtgaaattttctgaggccaatttaaagaacagactgtctttttttcttaccatggtgctgcatattattggtgctaatgctacacctaagggatttcaaagctcatttccaaacatcatctcatttgaacttaaccagaattgggagatggactgtgcaattatttttacccagcattccaaaaggggaaaaataagcatctgaaaatgacttccccaaggtcacacaaagaaccaagacaagacactacgtttcctaactcctattactctgttttctattgtattatatactttatgcttgaacataaccaggcaagtcattttccttgaaaactctcaggagaaatgttctctagtcccaatcccttgtctaatttctacttaaacctatatcctcccccatttctccttctcggtaggcatgggggatcccacactgcagatcccacatgcctatcaggagagtagtgaccttatagagtcccacatggcagtgtaaagcagtgagagtcacctcttgggtccacggtggactgatccaaccatgtgggcagtggtcagaggggagtttttaaccagcagtggaccagaatgggtcacatcagcaaggttggtgctgcagcaaagtggccattgggatgataaagggatagtgatgctcacgtcccagtgtggatggtgggagagcatgcatgttgctttctgtgatagtatccatcatggtacatgagggcacagtcgtttctcctaactctggaataccaggtttcctcctcgactctctcaggattctcaggtaagagaggagaggcatgtgtgagggataggaggaagccgaaaggaaaacgaatgggcagagatgacataaaaggcatatttaatgagggattgccagggcaaaagaaatagatccccctttctttgacataattttcaaataatcatttgtatcaaacagcatttcccccttggggattttgagggacaggtaaggccaccaccccagtgcctgagtttatacttatagatacctgcctaagacactggatgtgtcttggagggggactgtggtcctgcattaggtaggtcggtgctaatgagctaatgaactttggttcaaattgtagaagtaaactgaccactgttccccgaagttgatacggcctgggtgatacttctcagactttcgagtgcctaagaatcacctgaagattccgattcagtgggttttagggtggagcctaaaatcttgcatttccaacaagctcctggtgatgctatgatgctagtccgtagactagctaagtagcaaggagccagggacattcagattacactatgtatgtggttttgcaccctgattttttttttccttttaacctcttaaaactttttgcttaacattttacataaatgttttccctatgatattaattattctttagactcatcgtttttaataaatgtgctatttagttacttggatgtgtagtgatatatttgatcaactaccttttgtttgaaatctaaaatgcttcctgtttttacctgtcataaatcatgatgtcatgagcatccctatttataaatctttgttggcttctctgcaccaaaactggcaagcaggacagagcattccattagggaaaaaaagaaagagagagagagagagagagacagaaaagtatataaaagaagttgaaaatactgttttaaaacaaatattgactgatctctaatgtccacatccaaggcacttgatgacaggaattatagaatattcagaaaaatagagtttttctttcacttctgctataacgtgtacttggaaactacaccataaagtataaagctcgaaagtggctggaatttctgcatacgatgtattgtaattacagattgcgctccaagatttgttataaactttgtgaagggaaaaaaacacaagctgtgttttgtatattaaacattaaaattgtaggctatatcgtatgcaatggaaggaaaatatgccacatacattgaatttttaaaaactaccataccataattttgcataaaaactaataaacaaattgtattaagtgggaaatagttaataatttggcctctctggtttgctgctgtgtcgccaggtcctggctcccattaagatgacatctagcctataggccattgaatagaaaaaagacattccttcctcaagcacttaacttccattcagccaaagcttatgtgtattgattttgttgcaagacacggtactgccgtctgctagaaaatggtgtagcaataaaatccaaatgtaaaatttctacattgtgaatagtacttcccagatgtggtgcacagtctgcacaagcataggcactggccctacatctaaatagatttttctggaatgaaagaatgaatgtattctattgatcctggttatgctttgaagctgtaatctgtcagtaccctctgtggtcactagataggaagttggagaatattcagagtgataaagagaagggtaatgggaaagtctaaatgagtgcttctcaaattttaatgggcgtatgaatcacccaggaatcttgttaaaatgcaaattataatttggatgtggggcctgggattctgcatttctcacaagctcccagttcacttatcatctgataagaatgctgttggtccataggccacacttcgagtagaaagactctaaaacaacagtcaatcttggcttcttgctaagtaaatgttttttagtaaaaattgtcactcttagttcattgaaattgattcagtattctattaatttctgtgttgaatcttggaatggaaagaaacttccaggtgattctaatgtgcagccaaggttgagaaccactggtctagtgaaaagtcatgcatccaaagcacctaaatgtagggactacgtgtaaaaggcattcacaaatgaaaaacatcaaataattgtgattttacattttaaaaaaagaattattcttcgtctgaatatatttatcaccacatgaatgatatacattactaagtattgcaggcgtgtccaaccttttggctgcactgggccacattggaagaagaattgtcttgggccacacataaaatacactaacactaacaatagctgatgacctaaaaaaaaaaaaaaaaaaaaaaaaaaaaggtccatgcatagttttcatgatatccaccaccacagataagcaaaatagtccttgcattgaaaaggttggacacagctggaaggagtttagaggccggaagagctctataggcagaaatactttgggaatgaaagtaatgggaggacataggacaagacgctgccctcccggtatctcaggtgtggcatgagcatacgtgacaggggcagtgagcacctgggctaaggatagctattctactcctccggcattgttcttcttacagagttgagagctcctctgcactttgtgtatgccatcggccagctgatagtactttgcaactctgatcaatcaacatgcttgcagattgttacaatcttgccgttttcccatccacgataatcgcatggctgtatcttaatgccagtttactgagttgtattgctaggggctttctaattcccagtaaagatttttaaatccctcagccattttcttacttaaaaccattaaaggtagctttaggtatgttgaggaatgtgtgtggatgatacagcatttctcttctgcctggaatagttgtcttccctattgccgctgcattccctcatctactctccatctcattttaacaaaggattggtattttagaaagaactcagattctctttggggaagcgagcgccaccacttgtaaggtgatttttaaagatatattcacaagttatttgatgcttctctcccaaagagatggagctacattccccttttcttagtgtgggctggacataaggactcagatagatctggcagaaaggatgaaatgtcacttttgagattaggttattgaaagactgtggcttctgtcttgggaggtgcgtgctcactttttcactcttaaactcctcactcggagaagccagctgccatgccgtgaggcagcctgtggagaggcccacgtagtgaggaactgaggactgctggcagccgtggcagtgagtgcagaagcaaatccttccccagttgaggctgcagatgactacagccctggcaaacaccttgactgaagtcttgtaagagattctgaggcagaaccacccagctaagaagctcctggactcctgactcacagaaactgtgagatgacatttgttttttaaaaaaattggtaagcttggctgggcgcggtggctcacgcctgtaatcccagcactttgggaggccaaggcgggtggatcacgaggtcaggagatcaagaccatcctggataacatggtgaaaccccatctctactaaaaatacaaaaaattagctgggcgtggtggcgggcacctgtagtcccagctactcgggaggctgaggcaggagaatggtgtgaacctgggaggcggagcttgcagtgagccgagatcacaccactgtgctccagcctgggcgacagagcgagactccgtctcaaaaaaaaaaaaaattggtaagcttgggggtaatttgtaatatagcaatcatcaactgacagaacttgcctgaaacaaaatatttttttcagcaaagaacctgctattctaagcttgctgaaactggctctgtattgaaaactagaatggaaaggaatgtttagtgtcagggtaaattcatgaatcagtggacccaacagaaatgcagtgtgtgtgtgcgtgtgtgcgtgtgtgtgtgtgtgtgtaaaatacatctcacttctttggaagtgaaagatgaatttttggaagaacaaaactacaatcagttctttgttgtcattgaaatcatttgataatccgaagcatgcacgcacactcccaaaagagtagaagatggtagctcacaagacaaggaagactggtaaagctactgaggtctgtgggagctgccctgtaagtcagaagtgcccacaagttggagccattaggttttaaatgacagaaacccaattcaagctagtaagcaaaaagagaatttattgtcttacacatctgggaagtccggggctacaacaaacttcggtactcctgtttacggagttctctgtctccctcatcatctctggccctgcctccctgtttctttcctcaacttctcctgtgagaaatcactttctttggccaccagtagcccagcttctcatcctgagtttgcctgctccatggcaaaaagtgcctttctcctaacaacaattaatccaaccctaggaacattctgattgcctggcttgggttgtaagcctttggcaaggggaaggtggtgaagatgttgtgattgacaggtttgcctggaccacatggaaagagagggagtgattacccaaggaacccaagaggagggtgggtgagagggctgttaaacaaaaatataatcaccgaagctccctacaacctggaggcttgatgagaataagccatgacacatggttgctgtcgtatggttgctgttctaaacacatggttgctattcttatggtgcttcagtgagatgcaactagaggctcaggttataggctgagttaagccaggaatggggttttcttctagaaacttctggaactgaaaagttaaattactaggaagtcgctggagaggttagctggccctccatgtctattctacttaaagctgttcgacttataagtatgagaatttaattcttctccactcagcaagagagaagaatgaggtgtctttgcctttatatttctaagagaactcatttagagttttaaaacacagggagattaaggatgtaggaatgtgtggaggtggtagacatctgctgaatttttttcataagagagtttgagttgagattctgacatatgcagccaagagatcctaataaagctggttctaaagagatccagattttcatattagaactataataaatgagatttatgtgcttttatgaaactttacgttagcaattaaagtattttgcactggaggatcagttcaagggcaaatctatgcaaaaatgttccaactgaaacctttgtattcagaatcacagtgtgttagaactgaaagaggcctgaaagatcctatttgttttttaagtaaaaagaaacatcttttcatatgtttaatggttatttgtatttcttcttttgtgaattgccttttaaaattatttctcatttttctgttggaacattaatttgcaaattatttgtaagtgtttttatatgcataatataaacatattatttgtcatatactgtatgcatctttcctttttccatgttatagtgctgctttctatatatccatgaagttttaagttttttgtaagttgatttatctctttgtagattatatcttagtgtttataactagtcaaaagacttcccaatacccaaatacactaaatagccacatattttattttgcaatttttaaaattttattgaattttaaggatctgtctttaatttaattatatataaatctttaacaaatctgaaatttaatttgtgaagtaggcatctaattttattttttcccaaatggttagccaaatattgctgtaccatttattaagtaatctagtttttccctattcaactgaaatgccacactgacttaatgttttatttgtttatttgaggcggcagaacttctcaaaacatttattaacagagaacaatgtttcatgtaattagcatttgacttaatagctcaatttgaagaatggaaaaaataaagggaaatgatagatttcagtactacgaacaacatttgttgggacttttgaaggtagataaattggaagaaaaagtattatgttgctttattttaaaaatagaagctagcaatttttagctgcatttgaggactttattttctttttgcattttcttccctgtggtctacagatttcctagcagacttaacatctggcattggggaatccttaaacccaaggaaggaactgctggcaggaaattttctgtggatgttaggattgggaaaaggggagatgaaataagggatgtgcttccttaagattataaactctatccacaaagcccctgtctggaattctgggttgaattgtatcctccccaacccccaccgaaaaaaaagacatgctcttcaacatatcttcctaacccccagtatctcagaatgtgaccttatttggaaataggatcattgcagatataattagttaaataaaaatgaggtcatactggagtagggtaggcctctgatccaatatgactggtggccttattagaagatggccatgtgaagacagaaacacacaaggagaagaccatgcaatgatgaagacagagactggagttatgcagctgaaaaccaaggaacagcttcttatgtacttaatttgtgtcagatttcactacgtgtcaaagcttgctataaaaccaccagaagctaagaagagaggaaggattcccctacaggtttcagaggaaacacggctctgcttacaccttgatttcagaggtacagctttctagtttgtgctcctttattatggcagccctaggaaactaaagcagccctcatgagttttaatggcctcatggcttctgacaccaaaatgcccccaaaacacctttgatctgaattttgtcaaattttgaacacttataggagatgatataactagaatatgatgagatacttattaaataaagcccaatgactccatgaattccaagtaaaagttaagtaaatcccttaaaatcagagctagaataattgttctgccactcattagctctgtgatcttaagcaagttatttaacttcttggggcctctgtttcctcatctgtaaaacaaaatatctacctcaaagggttatcataaaaactggacgaagtagtgatgcatgcaaaagtacttagaacagtgcttgatacagagtgagtacataatcgatgctcttcttctttttcatctcctacccctcctcctccacaagtgcagctgaacaaattcaaaatgatagttcatcaaataattgcaacaatatgctagacactcatataaagatccattgtaatgtagtcattttgcaatggaagtttggccgtgtgacaagaatgtgcccctgatatgtctccttgcaggttactatgaactgaattgtgtcctcccctggcaaactcatacgttgaagccctaatcctcagtgtgattgtatgtgaagatagggtccttggcagataactaaggctacaggagtcataagggtggcaccctaattctataggactgtagcctcataaaaagacggagagagagagagagctctctctatggcaagcaccgaggaaaggccacatgagcgtgcagtgagaaggcagctgtctgcaaggcacagagtgcactcactagaagccaaccacgctggcaccctgatcttcctcttccctcttcagagctgtgaaaaaattaatatctattgtttaagccacccagtctatggtgttttgttatggcagccaaactgactaattcacagattcaacactcaaagggttaaatatatatacctcttggaacagacaatgtggatctccctgcttggctgatcctccttccctactagtcttccaaatttgtagtgctatagggccctcttctttacccttggtcttctatctcaatccagcccaaggctttaaataccatgtgaaatggtttgaatgtatatgtccccttcaaaattcatattgagactcaatccccaatgcagcattgtcaagaggcaaggcctttaggaggtgattaggtcgtgagggagctgcctgtataaatgaattagaaccttataaaagggatggagggaactagctaagctctttttgttcttctcctttctcccatgtaaggatgctacagtgagaagatgccaggtcctcatcagacaccaaacttgctggtgccttgatcttggacttcccagcccttagaactgagagaaataaatgtctataatttataaattacccagtctgtaatattgtgcagcacaaagtgactaagacatcgtatgtatactgatgacatacagatttagtcctcaactcttccttcaactgcaggcctatgtgtccaacttccttcttgactcctccacttggatgaataataaatagccacctcaaatattttaaagtccaaaacaaacccttcattgaactgtttgttccctcttttcaaccatgccttgtccatgtggacacccccaccccaaaagtcatccttgatttctttttctttaccccctctgcccacatccaacccatcagtaagtcttgtcagttctacttccaaattatgtttttaatgttattcccatttctcagttccactatcaccaccacgactatttcttgccatagtctcatttcttgccatagtctcctaaatggtctcccagtctctagtcttgctgtcttataaattcctctccactcagtagccagagttatctttcataaaatataattttaattttacaaaaaaaatacatgtgcagagtttaagcaggcagagttcaacaaatgataccaccaaaaggaaacaaacaaacaagacataccaataccttccagataaataatttttaatggcttcagctcagagttatcttttcatttgtttgtttttggttaggttttttgaggtacaatttgcatagagtaaaatgcagcaattcacatatttaggtatacattccagtgacttttgacaaataaattcagtcatgtaaccactatgataaaaatatagaatatttcctttacccataagatatagatggatatagatatagatataaaagatacaaggtctccttctgttgcccttgaactcctgggatcaaacctcctgcctcaccctcccaactagcagggattacaggtttgagccactgtacccgtcaccataagttatattttaatacattaactgaatcatgtcaactctttaggcaaaaagccttcagtgactttcttctaacttagaataaaattcaaactctttgtcagggtccttgaagccctacaaaactcacttccatttacttctctgaactcccctaataacaagtcccctcactcagcagggccctgctaaggagtttcaatctgcttcatggacattcaacctgcctctccccttgtctggaatgatcttcctctgatgttccatccaccttactttttctgatctctttattcagtgtagctttcaattcacctcaagtaagttattaattattttatcctgtttatttcttatcacaatttgggataattttgttaatgtatctttttgcttgtttatgtcttagaccaccagaatgtagcaagataaaggcaggaccttggtccatttatgcaacactatattcccagctcccatgatattatctattctaccacacagagggttcttcatattaggttgaactatttggaattacccacatatgaccatttttaacctacaagaatggcgatttcatatggttcatttggtttataaatacttgctgaataaatgaatgaactgaaattttgagttgatgccaccaggaagagaatagacagttatatttgtgcacagttagaaagagttcgctgtcctgagttcacttgatcactttttatcctaaattgccacccgctaccgtcgtcgtcttccacataataattttctattaggaaaattattcattaaaacagataacatgggtcacttaagtgtaaaacttaaaggtaacacttttttaaggaaatctaccagaagaaaatctttttctaatttttaaagtttaatgaaacataatttacatacaatgtaaatggctaataatttacgtacgatagctaatttttaactcttcatgtttttctgttggcaggcaacgtgttggaccttccggagcttctcagaagacagagggttttcttttgaggtaaatttgatagtacattttgatagtacaggaggcgatacggcatggtgacagaaaagcgccggcttggttagcgggaccacctggcagggctgcaggctgtgccacttaccaggcaggggaccttgggccagctgcttggcctcactcaccctgtttcctcagctgcaattgggatgaacagactgcctgcttcggggttgcctaaaactcacattgcttaatgatgtgaaatgcttagcgcagtgcctggcatagagagaattctcattagatgatacctcagctgggctttaggagctacagaagaagctgcatctccatgagctcagcgtgtttctagctttcctttttgttttctattcaacctttcacccaactcagcttctcaatccctaaatgacaaaggtttgggaaggaagacttggaccgatgcttgcatttgtttctgagaattaaacgttatgttttcttcaatccaaataggtttgcttgtacagccttgttcaatggtttttttttttttttttctccatgataaatgactctcaacttcttttccctcatttaattgcttatctacatacaatgcctggaaggaaataaatgtaatggcccgtagcagttggccttcaggtatcaagtttaagtccctttaagcagaacagcaaattgagcacagaatgaactggtttcatggtagcgtactgcaattagatgcaagaatagggaaagcagggtgcttcaattggtgacacaattagtatagcactgggggacttctctttccacttcttcaactccgcctgcattccgctggctgaagagttgatgacatccctgaaaaatcttccctctcttgtttctctgatgccacctctgtgttctccgcctcactggccacacttcctttacctcccaaacttttaactctgagtgtcccaaacttgtctcatcacctacccctgctgcccagctccccagcctgttccccttctgacacgggcactctccttctgctgtcttgggagagaaacaatgaaggcctagttggcacttttatttctattcaaggaaccagactgtgaacaagtttaccatttagtcctttggactgtgtcttgaattcatccctcttctccattctcaccagcaccatcatcatgatggctaatatttcctgagcacctttcatccaggcatgatgccaggtgcaccaacttacttaatcctcatagccaccacctgagcaagctcctgttttataaatggaccagttcttgttgctattgtacaagttattttctttctataacgtcctccttgtcctccttccacattcttaaagaaacttgcccttcctttaaagtactcagggagccctgcattgcttcttgaagccttctccagcttcatcatctcacagtggtctctcttttcactaaatgtccaatatgctgcacataagtaccccaaagttagcacagaattgttccatggctgtcatatatgttaaaaatcattaaaagttcattttttctctcattatgggaaggatacatgctcctactagtaaatttagtaggtagaaaaaaattatcactatctagactgctttccatttagtctttatgcatagctttctgtctgcctatttttaccttgtgtttgtaacttactattataaaatatgcgtctctatgtgcattgtcaacattatttacaataacatggagtggattgacacgtattctctatatttggattaaaggagatagagtatgtgaaattaaatgggagaagtatctgatacataacaggcaatacaaatattatcacatagcgtcaacttatttgtgaatattgaaagctccaaaaaagaaaaaaggttttttttaattcccgtaatcacttattgcagtattgtgtacatacaaagtgctcaatcattttggaggaataacaattttttttcctcatcatgaagtaaggtatgctcactgcaaaaaatctagaaaataaagaggaacatactaaagaaaagaatactcccatataatctctgtcttcataaataatcttttgtaacacttatacactgctggtgggaatgtaaattagttcagccattgtgaaaagtagtgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggaatcaacctatatgcccatcagtagtagactgaataaagaaaatatggtacatattcaccacagaatactaagcagccataaaaaagaaaaagatcatgtcctttgcagcaatatggatggagctagaggccattatcctaagcaaactaatgaagaaacagaaaaccagatactgcatgctctcacttataagtgggagatacaccatgagaacacatgaacacaaaaagcggaaaaagagacaccatggcctacttgagggtggaggctgggaggagggagagaatcaaaaaacttcctatggagtactatgcttattacctgcgtgatgaaataatcactttgaacgtggtcagtacattatcttctaatctagactcttttctatgttctatatacacacagaaatacacatgcaaagctgaacacatgtgtgaaacaaaattcagacactcaaattttccgccaacacgtgataaaatcttgcacaatagcttcctccacagaggaaaatgtctttactacatcttaaaaatggggtaaatgaatagttaggctcttcagtgtaataatcatgataaatattctcaatatgcgaaaatacaaacaaaggactttctctcccagcaaatttagacccacatgaaaatttaagcacaatcattttaaacgaatttatcctggagcttagtggttcgagttcaaggttgaggagcagtctggggacatcagctcttaatatttttcaagttttggagcaagtggtttctaggttctgagtgaagtgaaacagaatctctaggggcatgtggtaaagataatcccatactatgtactgcgtagagttaaagagaagaggcgagagcatgaagataaaccagtacaatcagtcgttcacataccactaactacaatgatactcccatttgcttcctgtgaagtagttactaataatcactgatgtcgctttttaatttcatacatcctttaactgtcttcatataggtattgaaagagtcaacataaaagccacatccattttctaattttgaacaatagttagagaaacctaatatcttctcatatttttgtcttgcttctgtctcatgagttcccaaaatagatatattatctgaatgaagagttcatgggcaaatgtcacacttttcttggtttggctaattatatttctgcttttgcttagaataagattaattttcctattctgctaataaaccacgtgatggcaaaatgccttattctgagaaaagaagcctttggtattttaaagaattgggaagctatttcagataagctatcatatgcatgaagattaatttattcatatgaaatgttcaataaccagaaaagactgttttaaataaaaccatttcacaattaagtttttttttggttatggacagtgatttcttctaagaaacaaagcgcctgtctatatgaagaataactaaaataatggttagcaaatattgattggatccagccaagtgagcagcatttttgagtttacagatgtggtaactttgaactatatttacgtgcttataatgaaaccttacagttggagtaatagctttgttcctgagtctcatgaatattttccagctcctttgtcctaaatttctgcctgacaatcatccatttcaaggaataaaaggatataataagtgataaacctatgctggaaatttttaatctaaaaagttcacatactgtttctaataaactgaaaactattagagaaagatggaggtattaaaacctgttaataaggaaatcaatggcaacatattttaaatggttttgaattttataaagattttcttttatagcactatgtcctttttcttttcttctccttgtttgatttccaacagctgagctatttacttgttgagttatttcatatctattattccatttagaccttgaaccctgtgagggcagggactaactttattcctagtgcctgtcacatgatttgaactaaataagtatatttttccagcctgcactactacgtacaataaggagtttcttatatttacttgaaaatgttttcaaccttctagggatgacctctactattattattccattattgacctttctatgcttattattgacctttcatcttattattctgatttagtaagcagattttatgtctccttgtccataccattcaaggctatctagatttcaattgtatcttcagatttttaccttccacattgatgagtcccaatgtgaaccctccaaagcaggttcctactgcactcatcagtttctttggttgagggatagtggccactatgtccttctcaggatgttggagacatgatgaaataaagacggtgatattagccccctaactgtaatcactcatgctgctcccacccatgtctacccactggaacagggagtggtggcattggggtggtacagggcttgccgaggatgttggcttatagctgtatctccaaacatccagagcatgtcttctttttcacctctcctttagaatctgcttcctcgaaccatccctttaagtgcaggaagaaagctatttttaatgtgaaaattactgttccagttatctcatggtggaaattcttaatgggctcttactttgggcatctgtctggctctcagtgccagtaactttcttttcttcttatctttgttttgttttgttttgttttaaagatggggtctccgtcacccaggctggagtgcagtgatatgatcatagctcactgcagccttgaactcctgggctcaagcaatcctcccaccccagcctcccaagtaactgagactacaggcacccaccaccgtggttggctatcagtgctaataactttctgaagctccatgcctttaactccagcgttctttacttagtgttttgaaatatctgctgcccacaaatcctagcacatttctgaagttaccaagactttaagacctcccatactgctttttctcccatcttcccttctcagtgttattagcctcatagtttcaagggcccagcccagtatccaccacacaccatatcccatacgtacaaatacagcatagatagtattgaacatttcatttttcactttagcttggtgaaaattaatatgtatttaggtattttatagttatgactcttagttttgggttgtctatctgctccatccttatttctacctttaaatgcagagctatttccaccagcttgagataaaagaagacaatagatcctaagtcttccacttggttccctatgggttttgtttgtttgtttgtttgtttgtttttggtagagatgaggtcttactctgttgcccaggctggagtgcagtggtgcaatcatagctcactgcagcctcaaactcctgggttcaagcaatcctcctgcctcaggctctggagtcactgggattacaggcgtgagcgactgtacctggcttcgatttcctgattaaattattctctctgcagccagtttctttattccagcctgagtcattttcttgccctgggtgacatttttccgtcttggacatctgtcgtattgaaagcaagtcacttcatttatgtctgtcctcgacttctgtttgatacacttcccatgtctccaagtcacggtatttctgaaacaattcatattgcttttcattactaaactttttttccaaagtactcctctgcagccttcattcctgatatctttaaatttatctagaaggtcttatatgctagatctacatctcctttagacacttatcattaacccaatttagggtaacagaaattgttttttacattgagcactctcacaggtacctacaactgctcacagtggtcctagaaaggacataaagtaaattgaaatggacatcgtttggcaggtgatttttgtatccttcctgacgatgctggttcaactttaacatacaggtctaatgtttttttaatccctaacccaattaataatagaaaagtaatacatattcattctagagtatttggaaaatatagctaatcccaacaaccaatcagagataactacttatctttttcctttcagtctctttttatatacacatacacttaaacctatctccttatcaaattgtgatgagttatacacatagggaattgaaataaccaaatatttctataattcttataagtaaaaatagtaataaaaatgacattcaatttttacttgttgattccggtgtgcgttttcctcttttaaaatagttgtttagttttccaaattggccagcaaaaacttacttaatttataaagttactgaaatactctctctttaaaaatgaaaaaatatgatataataattttaatgataaaatgaaaaaggtaataaaatagaaaaaatatttatcttgaatgttggaaattgagacaaagcatattcaatgttcaattgaatgactatcaagtggtatctggaaaattttatagaaacctagtatttttatagatgtttttgaaaagaaatactggttattgggtttacttcactcaagaaatccttttgcttaataggggtatatcattaatactagttaagtgttggttattgtattgtataagtgttggttattgtatcttcacagtgctataaagaactacttgagaatgggtaatttataaagaaaaagaggtttaattgactcacagttctgcagggctggggaaacttacaatcatggcagaaggtgaaggagaagcaagacacatcttacatggtggcaagagagagtaaaagagcaaggggggaattgccacaccttaaaactatcagatcttttgagaacttactcactatcatgagaacagcaagagagaaatccaccgccatgatccagtcacctccccccatgcctttcctctaacatgtggggattacaatttgaaatgagatttgggtggggacacagagccaaaccatatcagttgtgtagattgaatattgaaatattgaaatcttgagtcatataatgaatactgaaatatatgtaattctcaaattatgaacacttagctggcaaaggttcttatatgtgaatggctcattaagctttggatttcctttccactgtgttgctgccctggatgacaacactgctgtccatacagacagcaccacctattggccagcacccagggcccactctgagtgatttccttaccacctttcctttttctcaaggtcctcatggccctgcagtgcttgagtacttgtctttgactgctgggaatcagtttgtttggctgaagactgtcacacttatccacacattctttaaaatccctttcttcttcttacacttctcttccaaagcttgcctggttaccttagttgaatctcactctctctctctctctctctcttctgtccttccgtccctcttcccttcctttttcttccttcctccctcccttcctcccttccttccttccttccatccttcctttctttgagacagggtcttgctctgttgcccaggctgaagtgcagtggcacaatctcagctcactgcagcctttacttcctaggctcaagcaatcctcccaccccagcctcccaagtagctgggactacagacgcgagctgccacacctggctaatttttgtatttgttgtagagacggggtttcaccatcttgtccaggctggtcttgaactcctaggctcaagtgatctgcccacctcagcctcccaaagtgttggattacaggcatgagccactgtgctcagcctcttttactttttttttcttttctttattaccaagcttctgctttgcttcttccattcttctttcctgttttctaagggattactgaagtgttttatttttttctctttttcttttttctcctcatactggtttggaaattatatattttctttgcattctttcagtagttgccattgaaatatttttagttgaatatttcattacattcccattccatctttgtttttatatttagattttatttcaccaaaaattttaaaaactcatagttgaaaatatcagatacttcctcatgagccttatatccctccttccttcccctgaaacaatcatttacatttcttttactggtcatgttggtatctacttccatgtctctaaaaaacattcatttctcaatttcttatatttctcaattttccagtttttggtattatctactgacttcccactctagaaaatgactgctcccaccatatatgtgccttctttcctcttcacgccctcacaatacagtcatattatgtttgcgtttgatatcaagcaatatatttacattaatataactatgcacaaactgttcacagctgagccatgtaggaaactatgataaatttttctttcctgagcagctttttgcttgccctggagctaattatcttgttttaccatttgcttagttttctatgtacttatcactaatttaatcccaaattatttgccagttctctaaatcttctcttaagctactaagatgcattgctttcatcttcctgacaaaatatgcttcattcttctgatggcctattggtctttatgcctgatgcgtaagacataaagctgtcatcttgggactttccctcagcatcattctggcctcactgtcttactctcctacatgtgtctcccaacctgggtgtatgtcctgggtgtgttgccctgatcttccactttattggtttaatttcttgttttggtgaagatggtaagttctggacagcttagttagggaaccctgatgttactgcatttaggttttcctcctggactgatcaggtaagattcttccaatctcctgtcagaagagtcaaagtctgctactactattttggatctgggtcaagcgagatagtggagtagagagaggtgggcattcagtatgcatgcattttcttaagctggctttgttcagtacagtgctcccaacttcaaccctgcttgggatccccaagcaggaaacctgttctctctctcctgtgaatatgcttcctgggaaagagaagggaaatagaagcggtagtgtaccttttcatgattggaaaggatctagtgatctgactgcttcttaaataaactttcaacgcatcattctcattttagtctctcctcttcaccacacttccagaagaatctgatgctgccaattcctgacacttgaaggctcttgagtgtaaaacaagttgcttcttggctttcctgctgctggtttagtactttaatttgggagttctgctaagtcttttctcactcatccaattttccaaaattgtgttattattgtttattttcccatggcccaggacttaaaaaaattcactgacaaattaactggatttggggaggaccaaatttgatgcatgtgtttaatttactccctacatctgggagctccattaaatttttacaagtataacttgacataataaaatctaaatttaattaatgtatttacccttcacctcaaaaatacaagggctttagaaactttcaatactaattaccccatattccttattaatgtttattgtttaaattctgccttttaaataccctccatctccaaattagccattgttccccattattgttgtgtataagagtgcttattcagatatagccagatgtttatacatttcttggtccaccatttcttcttgcatgtgactccttctttctgggttcagtgtccttaccattgaagtacatctttactgaagatgctgttggtgtcctgtccagaatctcttcaatgagctggcgtactcatcccttagctgctgagagtgttggctgctaatagttcacactctttccctgaggattccattcaagccaacaatttcagaaaatgcctggaaggtaacagccttcccccgtgggtagctcacagccaatgactgattgatacgggtgtacagaactgaggctccagaactccctgtgggatcagactgaggctagacttcagctaaacccatatctttcccagcttcttttcctgtcctattctgcttccttcctcgctgttcagatttcttctgagagcactccctcaggcaatcacttggacaggaatctaattctcagggtcagctgcaagagcccaatctaagacagttgatagcagtagtagttatatacacctgagtctaaggatgggattctggagtttgctcactcaccagtggtcccatcagaatctcttccctgaagatagtctcagatgtgctcctgcagtgaaattgctaacacttttacttgtagtgaaccaggacagcatataagtagaagcgaatgcattaacttctgtgatgtatctagtatttgagagtacaggtggaaaagtaacttgaaagattgttgaattgggagggtattgctaagcaccattgatgcactaagtatagatgccaggatcaaatctattaaccaccaatttaaacccaagtgtgagagtcaaagggcctccatggaagcctttaaaaagtccctcatcactggcagccagaaggccaactgaactgaagcccaggtgcagcctgtacttatgagtggcagaacgccagagaaggttaattctcagcctgtgtaagtctccctcaagagaatcagggtcctgattggaaaaaagtgggaacatgagaattggaatggggaaacttattagacacacttaaggaccttggcctcccagcttctccggaatatctgggcctacagaggtggcccactcccttgctggaagatggaagaccttctccttgcttgaaaactataagcttcgagtaagtcaagtgtcttacaaaacaatgttggtcctgctcagaatctacccccacttctctccccgataccagacagtatgaggactaagtttcagtataatccaactgggtaagtacagtgtctgttaagggaggggaggatcatatggcaaaggcactgcaggatctggctgacttaagccagcaggaccccagagaaaatgcctggaagtggatcccaaagatgctggatcaagaatggggaataggaagtcaggaaagggacactttgttgttatagtaatactgtgcagtgacataggatttgacaccctggcagtgaccctggaatgactgttagaagcttggctttcctagtatttctgtgacattaatcacattttaatcacaacttccatatctgtaaaatggaggactgggacaatattgattatttttaaaaaactgttattttaggtttgggggtacatgtgaaggtttgttacataggtaaactcatgtcatgggggtttgttgtacagattacttcatcacccaggtattaagcccagtacccaatagctatcttttcttctcctttccctcctcccaccctccaccctcaagtagaccccagtgtctgttgtctccttcttcacatttgtaagttctcatcatttagcttccacttataagtgagaacatgtggtatttggttttctgtttctgtgttagtttgctaacgataatagcctccagcaccatccgtgttcccacgaaatacatgaactcattcttttttgtggctgcacggtattccatggtataaatgtacccaattttctttatccaatttgttgttgatgggcatttaggttgattctatgtctttgctactgtgaatagtgctgttgaatatcaagcagctatggaatgcctccagaaagcacataggagtttgttatctgaaattcagacactgcatgcacaaatgaatggtaggaaaatgactccgaaaagtgaacaaaagaatgagaaaccaagccaagatgaacatttgcatgcacgtgtctttatggtagaatgatttatattcttcagggtatatacccagtaatgggattgctgggtcaaatggtagttctgcttttagctctttgaggaatcaccacactgctttccacaatggttgaactaatttgcactcctaccaacagcatataaatgttctcatttctctgtaacctcaccaccagcatctggttttcttttttttttttttttttttgactgtttagtaatagccattctgactggtgtgagacggtatcttcatagtggttttggtttgcatttctctaatgatcagtaatattgagcttttgttcatgtgcttcttggccacatgtatgccttcttttgaaaagtgtctgtttatgttctttgcccactttctaaggggtcctttgcccactttctatggggttgtttttctcttgtaatattgtttaagtttcttatagatgctggatattagacctttgtcagatgcacagtttgaaaattgtctcccattctgtaggttgtctctttactctgttgataatttcttttgctatgcagaagctcttaagagtaattagatccctcttgtcaatttttgcttttcttgcaattgcttttggtgtctttgtcatgaaatctttgtctgtttctgtgtccaagatggtattgcctaggttgtcttccagagtttttatagttttgggttttacatttaagtctttagtccatcttgagtttatttttgtaaatggtataaagaaggggtccagcttcaatctttcgcatgtggctgcttagtcaccccagcaccatttattgaacagggagtcttttccccattgcttgtttttgccagctttgttgaagatcagattattgtaggtgtgtggccttatttctgggctctctattctgttctattggtctatgtgcctggttttgtaccattaccatgctgttttggttactgtagccctgtagtatagtttgaagtcaggtaacatgatgcctccagctttgttatttttgcttaggattgccttgactatttgagctctttttggttctatataaattttaaaatagatttttctagttccatgaaaaaggttgttggcactttagtaggaatagcattgaatctgtaagttctttgggcagtatggcaattttaataatactgatttttcctatccatgagcatggaatgtttttccatttgtttgtgtcttctctgatatttttgagcagtgctttgtaattctcattgtagaggtctttcacctccctagttagctatattcctagatatttgattctttctgtcaatgggattgcctttctgatttaactcttgtcttggctgttgttggtgtataggaatactagtgttttttgtacgttgattttgtatgttgaaactttgctgaagttgtttatcagctgaaggaaattttgggccaagactataaggttttttagatataggccaagtgttgtggctcatgcctgtaatcccagcactttgggaggttgaggtgggtggatcacctgaggtcaggaattcaagactagcctgaccaacatggagaaaccctgtctctattgaaaaatgcaaaattagccaggtgtggtggtgtatatcactaatcccagctgctctgggaggctgaggcaggagaatcacttgaacccaggaggcggaggttgtggtgagccgagatcatgccactgcactccaacatgggcaacaagagtgagactctgtctcaaaaaaaaaaaaaaaaagaggttttctagatatagaataatgtcatctgcaaagagagatagtttgacttcctttcttcctatttggatgccctttatttctatttcttgcctgactgttctgtctagaacttccaatactatgttgaataggagtggtgagagaaggcatccttgtcttgtgccagttttcaaggggaatgcttccagcttttcccattcagtatgatgttgactgtgggtttgtcaaacatggctcttattattttgaggtatgttccttcaatacctagtttattgagagtttttaacatgaaggggtgttgaattttatctaaagcgttttcggcatctattgagataattatgtggtttctgtctttagttctgtttatgtgatgaatcacatttattgatttgcgtatgttgaaccaaccttgcatcccaggaatgaagtctatttgatcatggtggattagctttttgatgtgctgctggattcagtttgaaattattttgctgaggatttttgcattgatgttcatcaaggatattggcctgatgttttcttttttgttgtgtctctgccaagtttttgtatcagaatgatggtggcttcgtagaatgagctggggaggagtccttcctccccagttttttggaatagtttttatagaaatggtaccagctcttctttgtacatatagtaaaattcagctgtgaatccatgaggtcctgagctttattttggttggtaggctatttattactgacttacttttggagatcattattggtctattcaggggatcagtttcttcctggttcagtcttgggagggtgtatgtgtccaggaatttatccatctcttctaggttttctagtttgagtgcatagtggtttctagtggttatttttatttctgtggggtcagtggtaacattcccttcgtcatttccagttgtgtttatttggatcttctctcttttcttctttattagtctagctagtagcctatctatcttattaattttttaaaagaaccaactcctggatttgttgatcttttgaatggtttctcgtgtctcagattccttcatttcagctctgattttggttatttcttgttttctgctagctttgtggttgatttgttcttgcctctctaattccttcatctgttacgttaagttgttaatttgagatctttctaactttttgatgtgggcatttcatgcgatgaatttcccttttaacactgccttagctatgtcctagagattctggtatgttatatttttgttctcattagattcaaagaacttcttgatttctgccttaacttcattatttacccaaaagccattctggagcatgtttagttttcatgtcattgcctgattttgaatgattttcttggtctttgacttctatttttattgcgctgcggtcagagagtgtgtttcgtattatttcagttattttacatttgctgaggattgttttacgtccaattaagtagttgcctttcgagtagatgccatgtggcgatgggaagaatgtatattctgctgtttttgagtagagagctctgaagaggtctatcagatccatttggtccaatgttgagttcaggtcctgagtatctttgttaattttctgcctcaattatgtgtctaatattgtcagtggagtgttgaagtctcccactattaatgtgtgggagtctatgcctgtttgtaggtctctaagaacttgcttcatgaatctgggtgcccctgtgttcggtgcatatacatttaggatagttggatcttgttgttgaatcgtaccctttaccattatgtaatgcccttctttgtcttttttgatctttgttgttttgaagtttgttttgtctgaaattaagattgcaacctcagcttttttctgttttccatttgcttggtagattttcctccatgcctttattttgagccttttggtgtcattatgtgtgagatgggtctcttaaagacagcataccattgggacttgcttttttatccatcttgtcattctgtgccttttaagttgagcatttagcccatttacattcaaagttaccattgttgggtgtggatttgatcctgtcattgtgttgttagctgattattatgttggtttgtttgtgtggttgctttacagtgacactattctgtgtgtttaagtgtgtttttgtattagctcgtagtgatcttttctttctatatttagtgcttcttttgagatctcttgtaaggcaggtctggtagtaaagaattccttcaacatttgcttatctgaaaagaatcttatttttcctttgcttgggaagcttagtttggctgcatataaaattattggttgaagattgttttctgtaagaatgttgaatataggcccccaatctcttttggcttatagggtttcagctgagaggtccactgttagcctgatgggatttcctttgcaggtaacctgccttttctttctggctgcctttaacattctttctttcatttttaccttggaaaatctgacaattatgtgtcttggggatgatcttcctgtgtagaatcttgcaggagttgtctgtatttcctgtatttgactgttgtcctctctagcaaggttgtggaagttttcatggacaatatattgaaatatgttttccaaactgtttgctttctcccccttcctttcagggatgccagtgatttgtagatttggcttctttacataatcccctacttcttggaggttttgttcattcctttttattcttttttctttatttttgtctgactgtcttatttcagaaagccagttttcgagttctgagattctttcctcagcttggtttattctactgttaatacttgtgattgcattgtgaaattcttgtactgtgttattcagctatgtcggacccattaggttctttattatactggctattttgtctttcagctcctgtatcactttattgtgatttgtagtttctttggattgggttttgctgtcctcctgaatctcaatgatcttcattcctatacatatcctaaattctgtttctgtcatttcagccagctcagcctggataagcactcttgttagagaatttgtatggccatttggagcacatatgacactctggccattttaatttttggagttcttgcgttagttctttctcatctccatgtgtgggtgttcctttaactgccatatagattgagtacagtcaatagacttctggctgttttcactaggctgaggccttgtgcagggtctttttttgaagctgacttcttgtctctagtttcagaggtgagtatgttagtgaggtattcttggtgttgaagctttggggtgtgatccagtaggtggcacttaggcttattggtcaactggtagactcttgctcagttgtgtggctcctctatgttttctcatagttacagctgtgttcactctcgatgctctgaaagtgtgggttcctctcccccttgagtgccagctgtatggctgtagattgtggtttgacactcctggctgcccactgcagctctggggcaatgtcagtgtttacgttccttcctcaacttggcggcaacagaggaaaggaccttagtagtggttgtggtcaggggtcttttgcttgtatcctgggagctccacaccagagagatgtaggtcagcaattcctcagtgcaatcaccccaggatgaagggtctgtgctgtgggctcaagccaggggttctctctggtgatgagtgggggttgggggtgtgggaaccatgggagacggactggcctcctcttcttgggttgattgcagcttgttggaggtataaataaggtacttagggtcttctcttcttcattagtctgagggtagcaagggcagttctactgcagagacagtggcagagaggctttcaggaacagtatttattaaccaattgtttcaacaaatatttactgacaattcaacatgtaccagacactgtgttaggcaaggggtcttcaatgggccacaagtagatgtggtccttgaccatgtcattggagcttaatgggagagactgatagtaagcaagtaaacaagaacaaaaaaataaggtaattcaggttgtgacaacctctctgaaggaaatatataggatgctataatagtgactagagcaaggaacggcctaattgagctaagataatcaggtagggtgtctgtaaggagttgacattaagctaacaactaaagaataagaagccagccatgtaaatagcttggataagagctttccaggctgaagggaatggaaatacacaggcctagaggtaagaaggagatgggtgtcttccggaaactgataaaaagtcagagtggctcagctatgctgatatgtcccctggtattttttaagatttttggccgggtacagtggctcatgcctgtaatcccagcactttgggaggccgaggtgggcagatcacgaggtcaggagttcaagaccagcctgactaacataatgaaaccccatgtctactaaaaatacaaaaattagctgggtgtggtggcacgtgcctgtaatctcagctactcagaaggctgaggcaggagaatctcttgaacttgggaggcggaggttacagtgagttgcgatcgcaccactgcactccagcctgggtgacagcaagactccatctcaaaaaaaaaaaattaatttttgagggtatattataggtgtatatatttatggggtacatgtaatatgttgatacaggtattcaatatgtaataatcacattacggagaatggagtattcatcacctcaagcatttattctttgtgtcacaaagagtcccattatactcttagttattttagaaagtacaattaaattattattgactatagtcaccctgttgtgctatgaaatactcggctgtattcattctttccaactattttttttgtacccattaaccatcctcacctccctacccaccccacccctattacactacccagcctctggtagccatccttctactctctattttcatgttttcaattgttttgatttctagatccaaaaataagtgagaacatgtgatgtttgtctttctgtgcctggcttatttcatttaacataatgacctccggttccatccatgttattgcaaatgacaagatctcattcttttttatggctgaatagtaatccattgcagataagtgccacattttctttatccattcctctgtgaatggacactcaggttgcttccaaattttggctgttgtgaatagtgctgcaacaaacatgggagtgcaaatatattttctatatactgatttcctttcttttgagtatatacccagtagattgttgggtcatatggtaactctatttttacttttatgagaaacctccaaactcttctccatagtggttgtactaatttacattctcatcaacaacatatgagggtttccttttctctacctcctctccagcatttgttactgccctggtgttattttgcttcttaagtattagaactatacttagtgttatatgttctgtgattagaagtaaaactgcctttgctatatagtatgcatagaatattttaaagttattactagaagctgacacattgttgttttctattacaaacaataaaattagtttccatttattgagggcctgtttcatgttaactgctttacagatattccttatctcatttaattctcccaacaatcctacaagaaagctaatattatcccattttatagatgaggaaattgaggcttacagagggcaagtaacttgcccaaagtcactcagtaccagcaaatggactttttcccctctccctgcccccaaataccagccccccactgcaaaaaaacaaaaacaaaaacaaaacaaaactacttctgtagagctagtcgtctatttccaaatgcaaggcttaaattttaagccttggagttttcaatttaaagcctttgccatgaaatacagcatattactttataatagaaaacaaatagaaagagcctttcatgatagatacagtgaacactaaattctttcttttaggctgcatctaacaattctctccttaacccaatagatattatttccacaaattagcccagttttgatttggatggcaagactcaaagacaacaacaacaataaaatcacaacttgatttaaaagttaaattcaataaactgtagaagcagcatattagtctgttcttacactgctaatgaagacatacccgagactaggtaatgtataaaggaaagaggtttaattgactcacagtttcacatggctggggaggcctcacaatcatggtggaaggctaaaggcacgtcttacatggtggcaggcaagaggtcctgtgtaggggaactcccctttataaaaccatcagaacttgtaagacttattcactatcataagaacagcatggaaagaagacaccctcataattcaattacctccaccaggtcccacaattgatcccacgtggggattattataattcaaggtgagacttgggtgggcatacagagccaaaccatatcatctgaagggggccagcccctccacagctgtgggtatttctcgtcaggtgggatggggagactgagaaaataaataaaacacagagacaaagtatagcaaaagaacagtgggccaaggagaccagcgctccacatacagaggacctgcatcggcaccagtctctgagttcccttagtatttattgattactattttgattatctcagcaaggagaatgtggcaggagaacggggtgatagtggggagaaggtcagcaggaaaacatgtgagcaaaggaaactgtgtcacaaataagttcaagggaaggtactatgcctggatgtgcatgtaggccagatttatgcttctctccacccaaacatctcggtgtagtaaagagtaacagagcagcattgccgccagcatatttcatctccagccacagggcagttttctcctatctcagaatagaatgaatgtatgattgggttttacactgagacattccattcccaggggcatgcaggagacagaggccttcctcttatctcaaccacaagaggccttcttcttttactaatcttcctcagcacagaccctttatgggtgtcaggctgggggacagtcaggtctttcccttcccacgaggccgtatctcaggctgcctcagttgggggaaaccttggacaatacccaggctttcttgggcagaggcccctgaggctttccgcagtgcattgtgcccctggttaatcgagaatggagaatgtcaatgacttttaccagcatactgcctgtaaacatattgttaacaaggcacattctgcacagccctagatcccttaaaccttgattccatacaacacatgtttctgtgagcacaggcttggggctaaagttacagattaacagcatctcaaggcaaaacaattgttcagggtacagatcaaaatgagtttcttatgtcttccttttctacatagacacaggaacagtctgatctctctttcttttccctacaatcattccacccctggcccctctcaaatctcatgtcctcacatttcaaaaacacaatcatgcgctttcaacaatcctcaaaaaactgaactcatttcagcatcaacccaaaagtccaagcccaaaatttcatctgaaacaaggcaagtcccttccacttatgagtctgtaaaatcaaaagcaaattagttacatcctagatataatgggggtataggcattgcataaatatacccattccacatgggagaaattggccaaaacaaagaggttacagggcctatgcaagtccaaaatccagcggggcagccaaatcttaacactctgaaatgatcttctttgactccatgtctcacatcctgatgcaagaactgggcgcccatagccttgggcagctccacccctttggctttgcaggctacagcccctctcctggctgctttcatgggctggcactgagtgtcttttctaggtgtacagcgcaagctgttagtgtatctaccattctggggtctggagaacagtgcccctcttctcacagctccactaggcagcaccccattggggactcagtgtgcaggctccaactccacattccccttctgcactgccatagcagaggttctccatgaaggccctgcccctacagcaaacttcttcttggacattcaggcatttccatacatccaatgaaattgagacagaggtttccaaaccttggttcttgacttctgtgcacccacaggctcaacaccatgtggaagctgccaagctgcaccctctgaaaccacaacccgagctctaccttggccccttttagccatggctggagcggctaggatgtaggacaccaagtccctaggttcctcacagcaatggggccctggacctggcccaggaaaccattttttcctcctaggtctccagtcctgtgatgggagaggcttccaggaaggtctctgacatgccctagagacttttccccattgtcttgggtattaacatttggctccttgttacatgcacatttctgcagctggcttgaatttctcctcagaaaatgagtttttcttttctatcacatcatcaagctgcaaattttccaaacttttatgccctgctttccttttaaacataacttacaattccaagccatatctttgtgaataaataaaactgaatgcttttaacagcacccaggtcacctcttgaatgctttgctgcttagaactttcttccaccggatgccctaaatcatctctctcaagttcaaagttccacaaatctctagggcaggggcaaaatgccaccagtctccttgctaaagcataacaagagtcacctttgcttcaattcctaacaaacccctcatctccatctgagaccacctcagcctgtactttattgtccatatcacttcagcattttggtcaaagccatcaacaagcctctagcaagttccaaactttcccatacttttctgtcttcttctgagtcctcgaagctgttccaacctctgcctgttacccagttccaaagtagcttccacattttctgatgtctttacagcagcactccactacccagtaccaatttactgtattaatctgttcccatgttgctaatgaagacatacccgagagtgggtaatgtgtaaagaaaagaggtttaattgattcacagttccacatggctggggaggcctcgcagtcatggtgtaaggcaaaaaccacatcttacatggcagcaggcaagagggcatgtgtaggagaactcccctttttaaaaccatcagatctcatgagacttactcactatcatgagaacagcatgggaagaaaccccctccccatgattcaattacctcccacggggttcctccaagaacacaaggggattattacaattcaaggtgagagacttgggtggggacacagagccgaaccagctcaggaggaactacacaacaataaaaacaacagaaaacgtaacatgtaaccaatagcaactgaaatgtttacgtttttggtgattatatcaacatcaaagaaatgcaaatcaaaaccacaataagatgccatctcacaccaatcagaatggctattattacaaagtcaaaaaataacagatgttggcaaggctgcagagaaaagggaatacttatatactgtttgtaggaatgtaaactagttcagccactgtggaaagcaatttggagatttctcaaagaatttaaaatagaactaccatttgacccagcaatctcatgactgggtatatacccaaaggacaataaataattttacacaaaagagacatgcacttgtatgctaatcacagcactattcacaatagcaaaaacgtggaatcaacctaggtgtccatcaatggtggattggataaagaaaatgtggtacatatacgccatggaatactatgtagccataaaaaagaatgacattatgtcctttgtggcaacatggatgcaactggaggccattatcctaagtgaattaacacagaaatggaaaatcaaatactgcatgttctcacttataagtgggagctaaacattgggtacacatggacataaagatgggaaaaatagatcctggcaaatactagagggaggagagaagaagggggcaagggttgaaaaaccaactattgtgtatttttctcactacctgggtaacggactcaacttcatgaaacatacccatgtaataaacctgcacatgtacccactgattctaaaataaaagttgaaactatacatattttttaaagaagctacctcagtactctttgtgaaaggtgacaaggcagtggaaatggaatggtaaggcgatcaggaattcaaaagacatttttaaagtgtaatcctcttgaaacagaatgaagaagaagacaagaggattggatacacatacaggttgcaaagagggtctgtagcacctctctcttttgaaatgtataattacactactgtatacctagggaatgtttcagagaagaaagatggggaatacaataaattgactaattacttgagattttctctagttttatctggtttaaaaacagtattataaatatatcctaattcagaggaagtaatcaatgacgaattatcctatattctatctcttctgtatgagaccattccaatatttctactctggaggacgctaataggctcaccctggaatgcccaacttcctctatactgacttacaactttgttcaaatcccaagatacatctatgtaaataatgcaatcaactcttcacatatgcagaatgagcttggcctttagcaagatgtaacaacttaacattataggatgctcctataactccgtcattcattcttcctaaatcaatgtcttccatcctctgagtcctttctctttaattctatttttgttatttttctttgccttaggtttcactcacttttatggtaaacactttaggtaatatttttcatgaaggatggattatgaaaataaatgatacattgtaagccattgacatgttataccattgggataaatgatggtaggtaattttagagtttcaatttgataaaaggggcttcgccaaatgataaggcttagcattaaggtatttcaaattgttatatattcagatttaattttatgaaagttaagatcatgtaatatgcctcaaccacataaattgataaattaccttcatctccagtcaaccatttacaccattttccaagagatgagttttaatgtaatgtgaggcagctttattctctgagtcatctgtagtacttcttgttactacagccaaagacctcatcagcattttcattttcattataaattccaaaccatcaataaaaattaaaaactcaacaccagtttatgaaacaagggggagaagagaaaaatatgtatattttcttgcatattttgggatcgtgtataagagaaaatgattttttctgcaaagacaagattgaattgggcattctgaatacatgttgttgagataagccaaatatttggtcctagaagctgagaggatatgatactgaatgattatttagcactaaaggtttatcttcaaagaggtcttgaaataagaatatgtaattaggctgggcacagtggctcacaactgtagtcctagcacttttggaggccaaggcaggtggatcacttgagctcaggagttgaagaccagactgggcaatatggcaaaaccttgtatttttgtagaaaaagtataaaaattagccaggtgtggtggtgtgtgcctgtagtcccagctactcagaaagctgaggtggaaaaattacctgagcctagtggggtcaaggctgcagtgagctgtgatcaggccaccgcactccagcctgggtaacagaaagagtaagacaaagaaaaggaaaaggaaaaggaaaggaaggaagaagaatatacaattagtttctacttgagtcttaccggaatgcattttactgaatttcacttatgcaaacatatactggcttacaaaaatgtatgcaacatctttatgaggcagatactgtgttgtgaaacacaagaggcaaacaatgtagaagattcctctttctgttaagtttatagtccagaggagaagaaatacattacatatacaacctctaattcattcatttattcttttcttttctagttgttgagacagagacttgctctgttacccaggctggagtacagtggtgcaatcatggctcactgcagcctccacctcctgggctcaaacagtcctcccacttcagcctcctgagtagctgggaccacagtcatgcaccaccacacatggccaattattttattttttgtagagatgggatctcactatgttgtccaggctggtcttgaactcctgagttgaagcgatcctcctgccttggcctcccaaagtgtcgattacaagtgtgagccactgcacccgcccctcattcacttatttattgacaaatgtttactgaggtattatcatatgtcaggcatttttctaggcattgggaatatagcagtgtatgaacctgatactcactgctttgatggagcgtaacttctgattgtggtaagtactgcagaagaaaatgcaggctgctacaggaaccccttcaacataaagaactgtatgaaaatattgtacaaaaatatgattcaaaaatcctaaatgaaattcacattatcatttacgtgtaagggcagaagaaaatttttgaatatgcatgcatttataaatatatccccatgtactcttttgcagaaaactaaaagaacatagaactagaatttacacatcaaaatagaaaaagatgacctgaagataaaagagatgataggatttttttttttttttttttttttgaggcagagtctcgctctgtcacccaggcttgagtgcaatggtgggatcttggcttatggctcactgcaacctctgcctcccgggttcaagcaattctcccgcctcagcctcccaagtagctgggattacaggcatctgccaccatgcctggctaattttttgtatttttagtagagacggggtttcaccatgttgaccaggctggtcttgaactcctgacctcaggtgatccacccgctttggcctcccaaaatgctgggattacaggtgtgagcctccacacgcagccaatggtaggaatcttatagaggatatgttgagaacaaaagcaacctgaagccacacagcttaaaaagattaggaactgtttggttgggcatggtggctcatacctgtaatcctagcactttgggaggccaaggcaggaagattacttgagaccaggagttcaaaaccagtcttgccaacataacaagaatctgtctctatataagaagattaaaaattagctgggcatggtggcatgtgcttgtagccctagctacttgggaggctgcggtggaaggatcacttgggcccaggcattccagcttatgatttcagtgagttatgatcacaacactgaattccaacctaatggatggagagagactatgtctctaaaaataaaaaataaaaagattaggaactgtctgcactaagatgactttactattccaagaaatccttgcctaagaaagtaaagttgcaaattacttttttgtcttggaaactttccgatctatgtatctgtactcatacagcctcatcgggctaaacagccttcttttcagaacagtagatcactcaactgggttttcaagtgactgtttacctttcaaggctggctttataggtcttgcctcactgtatccagcaatccaaactttaccctatcccagtcaggactgcacacctcatattgaaagacataccttagaaccagactccccaaagcttacaaatatcccacccttgactcccttttctgaggctactaagattatgtgaagacagtcatcttccttactgcagtgagcaataaacttggtttttgttcatcagtaaaccattttggtggtttctggaggagccagcagttggcaatggttataaatctaaatctaaaagccatgtataaaagactgatgaatctagtaacataaaaataaactgcatgataaatatcataaacaaagtcaaaagacaactgacaaccaggttaaaaacatgctttcaacatatattacaggaaaagggctaatattcctaatatgtaaataattgttagaaattaagagatcaagcacccattagaaaaaatgggaaaagggcatcaatagacaattcacacacacacacacacacacacacacagagacacacaaatggctttaacaactctatagaaacagaaagtaggtcatatctttgttctgtgaaaaggctgtgcacacaaagctattcccaaatgctgaagaagcccagaaaccaaagaaggaagtgaacaaatccagttcgtcagtaatgggtgatttattgaggaacttatggacagaagtgtgatcttggatgactgcaagacaggtagatctccacactgttatttcccagacccaaggtttgtgtaccatatggaaagggtacacatgctccagcaaaacgattaaaggcaaccctccagaacaggcgaaaatgctatgtgtgtcctagcctataatttgtgtgataacatcagggttgttttgatcttatactagggacagtaaataaagtagaaaccagaagttattcatgggactgggtctaatcagaagtcaacatggtggattagcgtccaagatggggtggtttttgtctccacaaccttaacaaggctgttgaaaaagtgatccataaatacacatataatcacttttcaaagtcaagaaacaatagatgctggcgaggctgtggagaaaaaggaatgcttttacactgttggtgggaatgtaaattagtacaagcattgtggaagacagtgtggtgattcctcaaggatctagaaccagaaataccatttgacccagcaatcccattactgtgtatataccaaaaggaatataaatcattctattataaagatacatgcatgtgtatgtttactgcagcactattcacaggagcaaggacatggaatcaacccaaatgtccatcaatggtagactggataaagaaaatgtggtacatatacaccatggaatattatgcaaccaaagaaaggaaagagatcatgtcctttgcagggacacagatgaagctggaagccatcatcctcagcaaactaacacaggaacagaaaaccaagcacctcatgtttctcactcataagtgtgagctgaacattgagaacacatggacacagggagggaaataacacacactcgggcctgtcagcgggttgggaagagggagagcatcaggataaatagctaatgcatgcagggcttgatacctaggtgatgggttagtaggtgcagcaaaccaccgtggcacacatttacctacgtaataaacctgcatgtcctgcacatgtaccccagaacttaaaatacaattttttaaaaagaaaaatacatatatatacctgtaaagtgcaaattcataactagaaaaatgcagattaaaaaaatgctaagctattatttctcacctatcagatgggtaaaaattaaaataaaattttaactaataaaatgtactaaattaaaatatgacaacacattttgttagccagatcttaggaaaataatcactcttttcattgctgttaaggaatacaaactgctacaacccttctcaagggaaacttggcaatacctaatataactacataaggagccctataatctcacttataaaatctaccctgaagatacatatccaacaatatgaaaaacatatgtacaagtttattcattgtaagattatatataattgctaaatttaagaaacaaatactcatatatagaacagtggtttttaaataaactctaataattcacacaggagagcactatgcagctataaaataaatgaggaagagctctatggattcatattcagagatttccaaggtatatttttatgtggaaagcaaagtacagaagaatatctagagtatactactcttcatgtaagaaagaagtatatataagaaaatatacatatatccacatatatgaggaaaaacatactggaaagttaaactagaaacaaatgagattcgtcacctacagaggttaagtaggatcagtgtggaaaaattggggaataaaaatgggtagaaatgattagagagatgtgacacactcagagtattcctatatgcatagctctaattcctataaatatggtaatgtttcacccccccaaaaaataaataattaaaattaaccaggatgttggggaagggaagacccaaaatggaatataagcagtaacaaataagcccaactgtattacaaataaatgacataattatactaaatgggataaaaaataaaagaattatctaacataacctggagaacattattttaaccatatactagaaggctaaaaacagaaagaactgtatgaaaattttgtactttagtaaatttgtttttcatagggtatgggttagtatttctgaaactactttatgtatgtactaggattgagtaattaagaaatacactgtggatattgagagccagttttctgtcagataaaagagttaaaatagagaaattgtgaagtagcacaaactccagattgaaatcagagcaggaatatcagtgtgaattcatggatatacatgcagtgagatcccagtagcaatgagcacaactagtttccagatcttggtttctaaataccattctcgatgaaaggaaccagagctccttggggaaatgactgagtccagactagagcaggaggaatgcaagatgagcttagaccatttaaagtgccagaaagtaaagacatgttcacaaaataatgggggccaagtctacaagacgtcggagccaacttaaaggagctactaatgcccaaatctggacaatttgaacaacatgatcaactgtgtgaaaggcaagtacagaagtgtatctagaatatattactcttcatggggttgttttacagttaacttttttttaataagtagaaggagtacactctagaataatgataaaaagtatagtatagtaaatacataaaccagtaacatagtcacttattatcattattaagtattatgtactgtacataattgtatgtgccatacttttacatagctgacagtgcagtaggtttgtctgcattgcatcactataatcctgtgagcaatacgctgtgttaccaggttatgaaagctaccatgtcactacatgataggaaattttcagttcaattataatcttatgggaccacccactatcatacatgtggcctgccattgacctaaatgtaattatgaggtgcatgactatatataaatatacatatgttggacattctgataggaaaatgcctggatatataagaaacaatgcttttacctctgaaaatctgaataagggaggctagagagatagaaagacttttactcttcatataataatctttttaaaaaataataaacttttaaaaatactgtcaatattatcctaggaagcatagttttatttctgttttcattaattaatttggacccagcattgatgaagtaaagtttaacttttattttagtttttctcgattgttgaatgaacattctttctcccagtttccaattatgttatctacattgaatcactgcttgactccatttccatatttgtagtgttagtccctggtaagacaataaacttccttataagcaaatttagaagcaattatttaattcaagcttgcacaattttctcgagtccagcacgagttgttgccacatctaacaatagcaaagtaaaggttgcaatgcttactagtgatgatttcttgaggaagaaaaataagtcttacttaacaatagaaaccttttttgtcttgctgcccaagtcaccaattttatataggggaagtagttaaaattaactaattatgacaattccagggtaaattaatttcttagaaatgtttcagagaataatactttctgcctcaaaagtatgcatttattatgtatcaaataaaattttaaatttagagaacattgaagaaatatgagatcagagaaatcaaagattattattaaattacatttcttttggtatctcctgagatttctcaattatgcattacttgtattcattcatttattcattaaatacaatatttatctaaaacctgctatgaccaagactgggtgaggaactggagacatagctattaaaaaaatagtatttatatttataagtgatgaaacaaaaagaaaaaatagaaggtgaatcggtaggtaaaaagagacaatagactaccagccaatctcaatgtgtgaaccttgtttgtatcctgattcaagaaaagacattaaaaagattatctgaaagagataattaaaaatctgaattctgcctggatagttgatgatattaaagaggtattattcattcttaggtgtaataatgacattgtggttatgttacaaaaaggagtcatttcagaaacagactgaaatatttacaaataaaatcatgtgttgtctgggacttacttcaaaataatgtgtgagtgtagggaatgggcagggttgcagtagggacaggattggccatgggttgatggttactgaggctgagcgatggcatgtgaggttttattattttattgtttactttcatctattttcaaaaagttaaaaaatcagccctccctttgctgaaaaaagaaaaaaagaaaagaaaaactacaggttttgtccctgcctcctggagctttcagttgtagagagaaagcaacacttactgagaaactaaaagatgatgtgtgttgtaaaatgagagtgcagggtgacattgcaattgagcaagctatcttgaggtagagagagaaggtagtcaaagattttgttgacagtttagttagaactaaaattgatagcgccattgtactccagtctgtcacagactgagatattatctcttaaaaaaaaaatggctgggcttactttgggaggccgaggcaggtggatcacctgagcccaggagttcaagatcagcctgaccagcacagtgaaactccatctctactaaaaatagaaaaaattagatgggcgtggcggcacacacttgtaatcccaactattcggcaggctgaggcacgagaatcgtttgaatctgggaggtggttgttgcagtgagccgagattgtaccactgcactctagtctgggcgacagagcaagaatctgtctcaaaaaaaaaaaaaaaaaaaaagcctataaactaaaattgagagatgggtggacttgtgtgggagagagaagataggggcatatgccagacagaaagcagcatgttcaaaggtctgaagcatatgtacatgtatgcagtttacatcctatataagtcaaaattggatgtaaagtttaaaagttagctgaatattttgtttacatatgtcatagcgtttatctgaagctgagcagggtatatccacattattctttgccatgtcatctccaattacatgcaagtaaattcaacaagatttgttctctgtatgagggacgtaaagttgaataactcatggtcacttaagaaccttacagtccaatggtagagacagatatatttgtctataccttagcaaagtaaaacatgaaaagatctgtactaatggaatgagctggatactgtgagtgtatttaggaggagtgattagttacgccttattagaacaacaaaaggctcagagaggagcatgccactagagctgggttttaaaagttaagtaggacttgattaggtagagaaggggaaagagaggccattctaagcagaaggaacaacgtgagcacagactcagactcaaaagtacatattgtatccaaggacctgcaggtaaatgatgtggttagaacacaggcttaaaataaaattaaaaatggcctggcgcggtggctcacgcctccagaactttgggaggccgaggtgggcagatcacaaggtcaggagttcgagaccagcctggccaagacggtggccaatatggtgaaaccctgtctctactaaaaatacaaaaattagccgggcatgttggcacgtgcctgtagtcccagctactcgggaggctgaggcaggagaatcgcttgaacctaggaggtggaggtttcggtgagccgagatcgcgccactgcactccagcctgggcaacagagcgagacttcgtctaaataaataaataaataaataaatacaatttaaaacatctgttcagtgctgtgataagatgtcatttgcatgtttatatttttctttttttttttttgagacagagtctcgctctgtcgcccaggctggagtgcagtggcgcgatctcggctcactgcaaactccgcctcccaggttcacgccattctcctgcctcaggctcccgagtagctgggactacaggcgcccaccaccatgcccagctaacttttttgtatttttttagtagagacggggtttcaccgtgttagccaggatggtctccatcccctgaactcgtgatccgcccacctcggcctcccaaagttctgagattacaggcatgagccaccgcgcccggccatgtttatattttccaaatgcttcacaaagaaataaatgcttcctggcttccatcacaggcattgcaggaaaggaattgtctaactagatgactacagataatacaaagcagtgaataaaaatagaaggcagttcagaatatgtttcagctctcgattctctaagaaattgatgacaagtacaactgagttaacatcaaagcatcaaaccaagcttttcataagtgaattcagccatcttcatggtgcctgggcttccttgctggctcctgtcctcctgttcacctctggatttggtagttcctttagacttggtcctaatcctttttctcttctcatgttactttttttcccatggctttgaatatatacttatgactccatatttagcaccaactcaaacctctcttctcaacctcagatccaaatacccaaatgctttcaaggcattcttacttaaatgccgcacaaatgtaagatgtctacagctgtacttgttcttttccatcaatcctgcctcacctccagtcttccacatcctaatgatgccaccttctactcggatattcaagccagaacctggatattatccctgactccatctccctcatgttacacattcaaactctcactaagaccatttggttctacctaaaattttgtcttgaatctctccatttctgccttctttactgctgccaccctagtataaactatcatcctctcttgcaacaactttccaaacggtcatctaccttccactattgcctatgacaatgcattctctatcttagaagatgaagattcggtaattcccctgattagaatcctttagtgacttccctctactctttgatgaaatgcaaaatcctaactaaggctagcagcttcctgaaagatctgcccctatctctccatcatttcaaatcatttgttgcctgtgttattgtcctattggtttttagggtcttaaatgtgtccagaaccagctcacaaccttcatgcttgtttttttgttctttccagaaagttattttcccctgtctcttggttggttctctctttttaggggaagcttttgctaggacttagaaagtaaaaatctgttccatcactcatcaagctggattaataaacattgataaaactagctgcaaagtttacgggaaactagttatcccaaagacatgcgataaagcttcataacaaccccattctttgagtgattactgttttcttacttgctaagaaactttgttctttaaaattatatgctattagaaaagaaacgttgtcgtttgaaattatattattataacataaaacatcatagtgtcttggagactctaaaacactttgacacagagaatcagcctccatttccattccagccacagagcttaagaaaagggcttctggacacaataatccatatctgtcttaactttctagttttcaaggaagcagaaccctggatcctgcccagacctgatgttgactcctgatttgctttgagttcatcaaaagccacttaaatggtttcaattaaatctcacccaaactctactcttcccccaaatcctgtaatgattatcttgtccttgtttggtgagtgagatgcctcacagttctgtgtgtgatctccctcactgcaatgaatctataaatatgactttgtcgaactctaagttgtttccttgcgcttgtagactgattgaggtaggacatgtgactcttcttcaaaaagtcttctctaaagttcccacgacaaaataggtcctcctaattcgttgtatcatcagcaccttctacttttctttcatagtgtattatatccttcaagaccccaaaggaattcgatacttaagtcaaaatatttggttaaaaatattaatcagttatatctgctccactttgtcggtaacggggtaaagtggaaaacaatccaaatgtccaatacttaaagtttgaagcaggttaaatattccttacctcccatactacatctcatgatgtttgcatggtgcataaaagttttgtaagcctgtagtaatttgaaagattaatttttgaccaatttgaaaaagtttttaagcaagttgaagaaccttgacaaacaagcaaagcgggactgattaactgaattagaaagaaaaaaaacctgaaatggtaaaaaaaaattatttaacacattctttttattgtttagtttcttatgtgtatttttatatatttattatggtattaaaccaaggaatatcttatgacaggaaagcaaaaacaatacaaaggacacagtaattccacctatctacaagtagtagaacttaacatctttctttccttaacacattatctcccactgaacacaacaatttttttttatttttttattttactttttattttattttattttttttttgagacggagtctcgctttgttgcccaggctggagtgcagtggcgccatctcagctcactgcaagctccacctccagggttcatgccattctcctgcctcagcctcccaagtagctgggactgcaggtgcctgccaccacgcccagctagttttttgtatttttagtagagatggagtttcaccgtgttagccaggatggtctcgatctcctgacctcgtgatctgtgcgcctcagcctcccgaagtgctgggattacaggcatgagccaccgtgcccagcccaaccattttttattttaaacagtcttgtcattgaagctttaatattattaatttctaagctccaaaacctgagggaggaaagggaaggctgaagtctcaagaaagagcaaagtagtgagatgactgagatgcaacttcctacctcacaagtttgtcttgggttaattctaagtcctaaaaactaccaagtatccactcagtaaatagctgttgaataaatgaatgaacagatgtctcaataagcaaaattggtttaatatgtctatttagtgttcaatttctcataaggatgttatttccatgtttaggataaaaattcaaaatagagttttcagctccttacattagctaaggtgggtgtacatttatctcctgcctggtacctttcctttctgacaagtttctagtctgctgtattacactatctaaaacagccactctgagctgactagcaccttatcactttagactttcctcacctcctctggcccggcacatctaatattttgtttaatcctaagtactccagttattgctcatgtcaagaacagacacattatcactggaattcaggctgaggaagaaactccactgaagccttcagtctcaacattaagaatcaaggaaggcctttatttatttatttttcaaataccagccatccttcatctgcaccccaaatcatcaaatgtttttatcaactctctgtaaaaattttgaatttcttaaaaaactgaaacagagatgataaatacaagtagccagttttaagtaccactgcttcttacttcaaagaatttcctctagatttgctattgtttgcaaaatatatagcggtggctcacgcctgtaatcccaacactttgggaggccaaggtgggtggatcacgaggtcaggagatcgaagccatcctggctaacacagtgaaaccccgtctctactaaaaatacaaaaaattagctgggcgtggtggcacgtgcctgtagtcccagctactcgggcggctgaggcaggagaatcacttgaacctgggaggcaaaggttgcagtgagccaagatcgtgccacttcactgcagcctgggtgacagagtgagactccatctcaaaaaataaataaataaaataaatatatataaaacatatattaaatattccagttacaaaaataacaattaccaaaaactccaacaaataatacctgtgcctaatatacagtgtggcaatgttcattatgaagttttaatacagagaactttttttcagaatttttaagagaataaatttttcttttaagaatacctaagccttatgaacatctgatgttcaaatacccagcaatggctggtcgtcttttgcttgcctaaactccatctgaacaatggcaaagctctgctgaaccaaccaacataaggaattgcacatccccacatttctttccatctttttcttttctgtcagactttcactcttttgctgatagtaagtacccttaatctattaaaagaaatacaaaaatcacttctgacttgcctattctgtttcattatatgcatatttacatcaccactgtatgacaaattatttcacctcatagaccctgttttctgatctgtaaaagtggttaatggtacttacctaaaaggttgtaaaattttttaaaataaagtatgtaaagctttcagtgcaatgccttgtatttggcaagtgcattgtaaatgggagtattatctacatcaacatcttcatcaagattacaatactgctgtgactcattcctgattaaggtcatgcattacttaacaaggatatagtctgaaaaattcatcatgaggtgattccatcgttgtgcaaacatcatactgtgcacttacacaaacagagatggtatagtctacaacacatctaggctatatatggcattgtctattgttcctaggctgcaaacctggacagcctattattgtactgaatactgtaagcagttgtaacataatggtcaatatttgtgtacctaaatgtagaaaaggtacagtaaaagtaaactatagaagatataaagtggtacacttaggccaggcacagtggctcatgcctgtaatcccagcactttgggaggcagaggcaggaggatctcttgagcccaggagttcaagaccagcctgggcaacatgatgaaaccctgtctgtaccaaaaaaaaaataacaaaaaacaaaaattagctgggtgtggtggtgtgtgcctgtggtcccagctacttaggaggctgaggtgcaaggattgcttgagcccaggaggtggaggctacagtgaggttttttctttttcattttcttttcttttttttttttttttttggtttttttttttttgagacggagtctcgctctgtcgcccaggctggagtgcagtggcgggatctctgctcactgcaagctccgcctcccgggttcaagcagttctcatgcctcagcctctcgagcagcttaggacacaggagtgtgccaccatgcctggctaatttttgcatttttaatagagacagagtttcaccatgtgggccagactggtctcaaactcctagcctcaagtgatctgcctgcctcagcctccctaattgctgggattacaggtatgagccactgcacacagcctataagctttcttctatttaaaaatttttatttattttttactttcaaacttttttgtttaaaaatgaagacatagccaggtgctatggtgcaagcctataatcccagctactcagaaggctgaggtgggaggattgtccaaggccaggagttcgaggctgcagtgcaatatgattgcacctgtgaacagccactgcactccagcgtgggccaacatagtgaggcctagtctcaaaaaaaaaaaaacaaaaaacaaaaagacataaacacacattacacatgagactaggcctacacagggccagggtcttcaatatcactgtctttcacttccctatcttctcccattggaaggtcttcaggagcagtaacatgcatggagctgccatctcctatggtaactatgccttatctggaacacctcctgaaggactgttttgcagttaacttttttttaagtataaaaaagacactctaaaataataagacaagtataatatagcaagtacataaacccataacgcagtcgtttattatcattatcaagtaccatgtactgtacatattgtatgtactatacttttataggactggcagcacagtaggttcgtttacaccagcatcatcacaaatatgtaagtaatgtgttgtaccatgatcagctctgacatatctgggcaataaaaatttttcagctccactgtaatcttaaggaactaccactgtatatgaagtttgtcattgaccaaaaggtcattatgtggtgtgtgactgtaatataaaaatagctattgtgataaaattattttaagggagggagacaatgggttgggaagtaaaattagtcattttgttagttttttattgctgctgtaacagattatgacaaacttaaacattaaaataacacagatgggccagaaactgtgactctcacacttataagcccagcactttgggaggctgaggcaggaggattgcttgagcccaggagttggagaccagggtgggcaacatagtgagaccccatctctacaaaaaataaaaaacaaaattagccaggtgtggtggcacatgtctgtagctccacctactcaggaggctgaggcaggaggatcatttgagcctgggaggttgaggctgtagtgagcccagaccatgccactgcactctagcctgagcaacagagcaagacctgtccctaaaaaaataaaaataaaaaaaaacaacacagatgtattgttgtatagatctggagatcagaagtttcaaatgggttggcaaggctgctttccttctggaggctctaggaggagaatccatttccctgtctgtctcagcttctagaggctgcccacattccttggatctagcccccgcatcactctgacctctacttcatcacatcaccttctctccctttgtctcacatttccttttttataaagatccttgtgattacattggggacatcagataacccaggataatctcccaatttcaagatccttaacttaatcacatttgcaaattctcttttgccatataacgtaacagtgataggttctgaggatttgcatatggaaataatggaggccattatttagtttaacacagtcattaaaaaaagaaattggggcatttaaccttctagaaactgaattgaaatttctccataatcaatagaaaactttctattttctcaacactagtgaaacctgcttttctttggtgacaccagttgataaaaataaaactatttctgattcaatatgttgctttcccctttggttatcagtagtttaattgaattattgactacagttttatggcaaatgtgaattctgggttgaacaaactaaattgagatgcaaataccaatttgtaacattgatcctgtgggtgaataatttcatagtcccaacaaatgtacttatgtttaccaacttgcaatacaaggtctttttaaaagtaattaatttatttttatttttatttttttaaagacagggtctcattctgtcttgcaggctgttgtacagtggcctgattatagctcactgtagcctcgaaattctgggctgaaatgatcctcctgcctcagcctccaaagtagctgagactacaggtatgtgtcaccacacccagctaaattttatatattttttctagagacaagggtatgtagcccaggtatttgaccctccaaatctgatgttgaaattggatacccagtgttggaggtggggcctaatggaaggtatttggctcatggggcagatccctcatgaatagattaatgttctccctgggttgcaggtgagtgagtttttggtctcttagttcctgtgagagctaggttttacaggatttttttttttttaggctggtcttgaactcttgggctgaagagatcctcccacctcagcctcccaaggtgttgagattacaagcatgagccacctcacctggccaagagctagttgttaaaagagcctagcactaccctcctctttcttgtttcctctctcaccatgtgatctccacacacattggcttgccttccctttctgacatgagcggaagcagcctgaggccctcaccagatgtggatgccagtgccatgcttcttgtacaatctgcagaatcattagctaaatacacctcttttctttataaattacccagccttgggtattcctttatagcaacacaaacagagaaagacatatgcaatttgccattttaatcatttttaactgtacaatttggtggtattaattatatttacaatgttgtacaaccgttaccaccatctattaccaaaaccctttcgtcaccccaaatagaaactgtgcttattcagcaaaaactcccactttcctctccttccagcctctggtaacctctggtaacttctaatctacctcctgtctctatgaatttgcctattgtaaatatttcacataatggtatcatacactatctttttgtgtctagcttatttcacttagcataatgttttcaaggttcatccatcttatagcatgtatcagtattccattcttcttttctatggctgaataataattgtatgtatatactgcatcttgtttatccatttatctttttgtttgtttgtttgttttttaaagacagggttttaccatgttggccaagctagtctcgaactcctgaactcaggtgatccgaccaccttggccttggaaagtactgggattacaggcgtgagccatcgtgcctggcctatccatttatcttttgatagacattttggttgtttctaccttttgtctattgtgaataatgctgctatgaacattagtgtacaagtcactgtttaagttgttgttttcaattcttttgggtattgtattaggccattcttgcattggtataaagaaatacctgacactgggtaagttccaaagaaaaaagggtttagttgcctcacatttctgcaggctgtacaggaagcatagcagcatctgcttccggggaggcttcaggaagcttccaatcatgatggaaggcaaagtgggtgcatgcatgtcacatggcaaaagccagagcaagagaggaagtggggaggtgctgcacacttttaaacaatcaaatcttgtgagaactcacaatcttgatgacagctagagatggtgaagccattcatgagaaaccactcccatgatccaatcacctcccaccaggccccaactctaacactggagattaattatatttcaacatgagatttgcataggaacaaacagtcaaactatatcaggtatatacttaagagtagaattactgggtgataattctgttttacgttttgaggaattgccaaactatcttcctcagcagttaaaccatttacattcccaccagcagtatactaggtttccaatttctccacatgttcaacaacactagttattttttcttctaattatagccattctagtaggtacaaagtggtatctcattgtggttttagcatcttttgagttgcttattgaccatttacatgtcttttttttagagaagtgtctaagtcttttgtccattaaaaaaattgagttatttatcttttatttgttgagttgtaggattctttatgcgttcaattcttttgggtattgtattaggccattcttgcattgccataaagaaatgcctgagtatattagttttttgtcagatatatgatttgcaaacattttctccaattttttgtgttatcttttcactctctttatagtgtcacttgatacacaattttgatgaagtccaatttatcagttgtttcatcacttgtacttttgatgttatatttaagaaaccgttgtcaaacccaaggtcatgaagatttttcagtatgttttcctctaagagttttatagcatttaatatttaagtgttttatagcattaaattttggtctttgatccattttgagttaatttttgtacattgtgtaaaagtataggtccaacttcattcttttgcttgtggatatctagtttccccaacaccatttgttaaagagattgtccttttccccattgagtggtcctggaacccttgctgaaaattaattacccatagatgtgagtgttagttctggcctctcgattctattccattggtctatattgtctatctctgtgccaagtccatgctatttcaattactatagctatgtagtaaattttaatatcagaaaatgtgatcctacaactttgttcctcttcagattattttggctattttgggttccttgaaattttatatgaattttagaataggtttttccatttctgccaaaagcgctgttgggattttaatagcatgattacattgactctacatatcattttgagtagcgttgtcattttaacaatattaagtcttccaacttatgaacacaggatctctttccatttatttaagtctactttaatttctttccagaatgctttgtagttttcagtgtacaagtcttctgccttcttggttaaattgatttctaaatattttattcttttgggtactactgtaaataaaaaattcttaatttccttttcagatcttttactgctagtgtgtagaaacacgactgatttttgtgtgttgattttgtattctgaagctttgctaaatttgtttattagctttaagaggctatttttggtattctttagggctttctacacttatatcacttgcaaatagagatagttttacttcttcctttctaatttggatttattttatttctttttcttgccttatgggtctggctagaactgccaatactatgttgaatagaagtggcaaacacaggcatccatggcttctgattttagtggaaaagcttgaaatttttccccattgagaatgatgtcagtcgtgagtttttaatacatggtctttatcatgttgagacagttcctttctattcctggtttgttgaacagttctatcataaaggaggaatggattttctcaaatgttcttctatatcaattgagatgatcatgagtttttcactccttcattctattacttggtgtattacatcgactgattttcatatgttaaaccattcttatatttctgggacaaatctcagttggtcatagtgtaaaattcttttaagggctgctgaatttaatttcctagtattttgttggggatttttgtatctataatgcattcataggggacatttggctatagttttcttgtattgtctgtctagctttggtatcagggtaatgttggcttcatagaatgactcagaaagggttctgtttctcaactttttggaggagttcgagaaggattagtgttaattcgtttctaaacgtttggtagaattcaccagcgaagtcatcagttcctgggcgtttctttgttaggagagttttggttgctgattcaaccaaaattgaatatcattactttttatagatctattcagatttattctttcttcttgagtcaactttgttggtttgtgtgtttctaggaatttgtctatttcatctaggttatccaattttttgacatatagctcttatacgaattctcttacaaccctttttattcctataaatcagtagtagtgtttttcatttctgattttagtagttgagtattctttttccttaatctagttaaagctttgtcaactttgttgatctcttcaaagaactaatttgttgtttcattgattctattgtttttctattctctatttcatttatttttgctctaatccttattatttccttcctctttatggcttcaaactcaattgaacataaagtattaagaaatttgat

SEQ ID NO: 1762 - DNA, 1597 bp, Homo sapiens
tatcaccagaaccattcaagtgccacgaaataacacatttatgtattattctgcttcaggtgagctcaggaggaaaagacagatatctattcactaaaaatattcttttgattggccggcacggtggcttacacctgtaatcccagcactttgggaggctgaggcaggtggatcacctgaggtcgggagttcaagaccagcctcaccaacatggtgaaaccccgtctctactaaaatacaaaaaattagccaggcattgtggcacgcgcctgtagtcccagctactcaggaagctgaggcaggagaatcgcttgaacctgggaggcggaggttgcagtgagctaacatctcaccactgcactccagcctggtgacagagcaagtctctgtctcaaaaaaaaaaaagttattttgatcaacttcttatggacaaagttcagaaagcaaagaacaatgttttactacatacacatacacatgcatgcacacaaactagaaaaaaaaatttttttgagtgctttgtctggcatctggcgatggtgtttcccgcaccatctggcctgtggtctgtggggacgtacatacgtcttgttagggctctccatccagtccacacatcaatggcttgcctggcttacgtagtctgagcaggtgcccagctttgtcgcagatattgaagccgtgtaaaataaatgccttttgattgttcacactttaagcaatattggtacaatattaaacccattgtcccaggcactccctctccttactgcttatggcacttcatgtattaaaaaatgacagtggcagcattgcccagacatgcgttttgtcatcaagtcttaatgcagtccacctggtccctcaggcaaatgaatggaggcacagaagatgaaatgattttcaaaatgccattaggaaagctcaggccagaactggaaatgggtcccgcacagggcactcggccactcttgcctggccatctcctttttggcactaagccacaagcacacaatgatatagaatgaatggttatcactggggatccagaagggtcattcaatcagttctcagtcttatcaggtctaagttcctttcttatcaggtcctaaaggcctaatcttatcattgtgacaaagataactgtagagtctgttaaacttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagc

SEQ ID NO: 1763 - DNA, 5374 bp, Homo sapiens
tggggaaaaagatttgttaaattgcctcctaaatctccaaagaataggaagaacagtagatcagcttagctctttcaaatcagggcaatgttgggctaaaagaacagcaactccttccactggtttaatcatgttggtctccaactgctttaggaatgttgttttatgttagaattctttcttgtaagagagttttttaaattatagaagtaattttttaaaatgtcaatttataaacttgaacacctctttcctgactcctttaccaaaattcaggttggcgagcactttgccgtattgagcgacgggttagtgactttttttaaagtggttcttctaagaaacagacagttcagaaactgcttctcagacttcagtgtgcaaacagattccctggatagcttgttaaagatgcagatcctcattcagtaggtcgagagtggggctcaagatcctgcacgtctaaacaagccctgacatgatgctcatctgctggcccatgtacccactttgagtagtagcaagcagatttttttaaatgttttatatatcaacaaatattgttagttttttatacaggaaatcaaacttccctttcttctttattcgttctcttctccctccaccttcctctaacctttccacaaagagtaaagggtatttgatttgcattgattgctgaggtgtttacgtgtatggcaatgaggcatcaactagcagtgcccttgattggagagattaggaagagttatgagaagaaatgacaaaaagttacttaaatttgagtataaatagcccagcgtgaggaacgtgaacactgagatttaaaaaacaatgaactctataatttacttatacatttaggccctagctaaagatatgcccccatcttcctctggactctactttctatttggggcccagtttggagtgggggcagccaggatgattggagacgtgtcactcttaggattaccagtggtaggtttggtagccaacctgaccctgtacgtcactccatttcatcctcatctgttcatattgaactgccacgggcaaagatgaatatgacgcagtcacctctactgtctgggaactcagtggtggggcttaggggccatgtcagccaattacaaactgaattctggggaggtaagtgctgtagaggaggcagacagctggttgaagggagaggggtcaccacagagccgccgaggagtctgggccgacttcatggggccggggagaagccagctggtgtggaaggccagggcggtgggtaaaatagcaacatggtgtgacataaatagcaccaactgcagcacgctgcagggagctccagagcttagaagggaagttttgaagaaaggagttctttggtccttaaggagagaagagaagtatttgctgtgggggctgggaggagggggtcaatgtcaggaaaagagtgtcacctagagccattcagagggcagctctgaggaacttcctggagatggctgcaggggtccttcctggtgccctgccctgtgaggggctggccgcagggtgtcatgcggagacaaagcttttctcagggacagctgtgtcttttgacattgcaaacattcccccgccagccccttgtcctgttagcaaactctgaagagatcttttcacagagttgcacctgaagtcgcacaggaaaagggcgccttcccactctagatgcccttcttgtgcagctttcaggaagcaggtttcatgagaggctagtgtttggtgcatgagtgataccttgttcagaataaaacagggggacaaatattcttttttcaatttctgatcttttttttaaaattattatttttaaaagggagatggggtctcactatgttgcccaggctggtctcaaactcctgagctcaagcgatcctcttgcctcggcttctgaaagtgctgggattacaggcataagccacatgcccggcctctgatctcttactataccactttctcgctacaccactgctgtcgtctatttgctgaatgtgttacaataggaagctgtgagtagtttggtgattttcaaactcgtttttaaggcaaagaaaagcctttagttgaaggaaattatatgcataaggtgtaaaaatagagctccctgtttgggagtgagtgaaggtcgacacctaagagcctgaagccctttggctacccttctccccatcctgtgccatcgccagatgacctgagggagccccgtggaaccactaaccaggaatactcaatgtgggcaccctggcccagcagataggcatcaccccggaatgtgtaagacctcctgaatcagaatccgcattttaacaagactgcagattgagaacttctgatctggagcctttctaatcactgacaacatccgcagtgggaaaagcaaccacactggctctgagggccactgtctatcttggctctgccctgcaccccagtcgggagctttaccacgccagcagactggcctgcgttcccatttcctcagctgaaaggtggaaagaatattacattaatgaggacagttcatgtgagcttacgctaggacttcatttaatctcacaatctgaaattaattctcacaattctgacaaccacgtcaggagcactgtagacattacgaccaccctaggttttaaatatggaaatgaaggcaaacggaggtgaggtgaacatttgtgactacccagccctgaaatggcagcttttctgactaaaaatccagaggactgcccccatttcagcgccatcctctcagggctgtggcaggggtgacatgccacaaagtcatgcttcctaaacatccctaccgacacagcccccatggaaaagagatgaatggctggccggccgggcgtggtggttcacgcttgtaatcccagcactttgggaggccgaggtgggcagatcacttgaggtcaggagttcaagaccagcctggccaatatggtgaaaccctatctctactaaaaatacaaaaattagccaggcatggtggcgcgcacctgtagtcccagctactcgggaggctgaggcaggagaattgcatgaacccaggaggtggaggttgcagtgagccaagatcgtgtcactgcactccagcctgggtaacagagtgagactccatctcaaaagaaaaaaaaaaaaaagagagagatgaatggctgagggtcgatgggcgtggctcggagatgcccactgcaaaatctaaactctaaatccctgggtttattcttaacaatttatacaagttttgcattcacttcctcatatagctgagtttatttaatataaaaataatgtttcgagaaacagagcttgaagcaaaaccagtgtttctgaaagaaacactgtttttgctgatcccaagcactccaccaacaccctccagggggcaagcaactgaacctcaaattgagaagcaggatatgaaggaacttgacaaattgtccaaggcaactctgaagtacggaattgttatctccagaaatcctgacatcacaaatatgacagttctctcacccctggccacaccaccgctccgtaactctctatggattcctggatgacaatctcctttcctgcaaaccgataatgctcctgagtgtagctggcgtaatctgtaggaacaaatttctggaggctatgaagagatggttctatcttgttggattctgtgaagcagaaaaataaaatggagttcatgatttgttcaaatccagtgcaaagacacacttggtataattgctaagatggcattagattgaatgacctttacataaagagaagggatgatgctatcaaggagaacggctgcaaattggcacaaaattgaattatatggggtgatggggacatgaaatttggatgtgacagttttatcagatgacaaaatgccaaagaatgctctgggccttttctttatttaggggaggacagaagatgtgtggatcggtccccaccctaaattttgctgatggaaaaatggcgaacttaccagcaaaattgcacgaatgagctgtctggatacagaggaactaggtaaacacaaacctgcctttttttttttttctttttgagacagagtctcactctgttgcccaggctagagtgcagtggtgtaatctcagctcaccgcaacctctgcttcccgggttcaagtgattctcctgcctcagcctcctgagtaactgggattacaggcgtgcgccaccacgcccagctaatttttgtatttttagtagacacggggtttcaccatgttggtcaggctggtctcaaactcctgacctcgtgatccactcgtcctggcctcccaaagtgctgggattacaggcgtgagccaccacgccccgccagacctgcctatttttaggtcttgaagtgaagtaacattcccacgtgttggctggagcatgttccttcaatctttcctacaattgctgttcaaaaggtagaggcccagccagccccacagccctgggggaggatgtcagctgagctctggctattaagttactattgctttaaatactcctttaaacccatgacccatctagcagctctcagatggcatataaaatgagaggaaaagagcacctgatcgggctgacatcaagagatcacaagtgtttgcaggttttccagagtgtttaggaataaaagagcagtgagtcaaagtgtgtggaagaaggagcaggagcagaggaaaaggtgttggtcccagcgggtgggaaagaattaacagtgcggagagtaggggggaggaaggtcagttttgtttgcacgaaacctgcctttgtggcctgggatatgactgtaaaatgtttaaccgggggtcaaatatgggctttggacaaaggtagaagggggcagccggtgaacattggaagtgttttaatctgaaatagcctctcaaggtggaaggcaggaggaggtgaatacgaggcaaagggaagtgggtcttgggagaaacctggtcagcagggcatccctcaggtcgggggcagggcctccgggtgtttcaggtctcactcattccatacacactggaacagttccctgccactgctctgcaaatgctgataacagctccacagtaagtagagggatttggagtgagcctttagaaacagtcacaaccatttgacgatgcctgttgaatctaactacaaacaaaacccggagcttgtattttatatgtctgtatatattttcatttaatttctctagaaattcatttttgttgtatattacaaaagtatcagtgtgcagcacactaaaaaaaaaatgtgaatgaagtgactcatttgtaaattagcatcatgggtgccttcagttc

SEQ ID NO: 1764 - DNA, 3325 bp, Homo sapiens
tgagtagtttggtgattttcaaactcgtttttaaggcaaagaaaagcctttagttgaaggaaattatatgcataaggtgtaaaaatagagctccctgtttgggagtgagtgaaggtcgacacctaagagcctgaagccctttggctacccttctccccatcctgtgccatcgccagatgacctgagggagccccgtggaaccactaaccaggaatactcaatgtgggcaccctggcccagcagataggcatcaccccggaatgtgtaagacctcctgaatcagaatccgcattttaacaagactgcagattgagaacttctgatctggagcctttctaatcactgacaacatccgcagtgggaaaagcaaccacactggctctgagggccactgtctatcttggctctgccctgcaccccagtcgggagctttaccacgccagcagactggcctgcgttcccatttcctcagctgaaaggtggaaagaatattacattaatgaggacagttcatgtgagcttacgctaggacttcatttaatctcacaatctgaaattaattctcacaattctgacaaccacgtcaggagcactgtagacattacgaccaccctaggttttaaatatggaaatgaaggcaaacggaggtgaggtgaacatttgtgactacccagccctgaaatggcagcttttctgactaaaaatccagaggactgcccccatttcagcgccatcctctcagggctgtggcaggggtgacatgccacaaagtcatgcttcctaaacatccctaccgacacagcccccatggaaaagagatgaatggctggccggccgggcgtggtggttcacgcttgtaatcccagcactttgggaggccgaggtgggcagatcacttgaggtcaggagttcaagaccagcctggccaatatggtgaaaccctatctctactaaaaatacaaaaattagccaggcatggtggcgcgcacctgtagtcccagctactcgggaggctgaggcaggagaattgcatgaacccaggaggtggaggttgcagtgagccaagatcgtgtcactgcactccagcctgggtaacagagtgagactccatctcaaaagaaaaaaaaaaaaaagagagagatgaatggctgagggtcgatgggcgtggctcggagatgcccactgcaaaatctaaactctaaatccctgggtttattcttaacaatttatacaagttttgcattcacttcctcatatagctgagtttatttaatataaaaataatgtttcgagaaacagagcttgaagcaaaaccagtgtttctgaaagaaacactgtttttgctgatcccaagcactccaccaacaccctccagggggcaagcaactgaacctcaaattgagaagcaggatatgaaggaacttgacaaattgtccaaggcaactctgaagtacggaattgttatctccagaaatcctgacatcacaaatatgacagttctctcacccctggccacaccaccgctccgtaactctctatggattcctggatgacaatctcctttcctgcaaaccgataatgctcctgagtgtagctggcgtaatctgtaggaacaaatttctggaggctatgaagagatggttctatcttgttggattctgtgaagcagaaaaataaaatggagttcatgatttgttcaaatccagtgcaaagacacacttggtataattgctaagatggcattagattgaatgacctttacataaagagaagggatgatgctatcaaggagaacggctgcaaattggcacaaaattgaattatatggggtgatggggacatgaaatttggatgtgacagttttatcagatgacaaaatgccaaagaatgctctgggccttttctttatttaggggaggacagaagatgtgtggatcggtccccaccctaaattttgctgatggaaaaatggcgaacttaccagcaaaattgcacgaatgagctgtctggatacagaggaactaggtaaacacaaacctgcctttttttttttttctttttgagacagagtctcactctgttgcccaggctagagtgcagtggtgtaatctcagctcaccgcaacctctgcttcccgggttcaagtgattctcctgcctcagcctcctgagtaactgggattacaggcgtgcgccaccacgcccagctaatttttgtatttttagtagacacggggtttcaccatgttggtcaggctggtctcaaactcctgacctcgtgatccactcgtcctggcctcccaaagtgctgggattacaggcgtgagccaccacgccccgccagacctgcctatttttaggtcttgaagtgaagtaacattcccacgtgttggctggagcatgttccttcaatctttcctacaattgctgttcaaaaggtagaggcccagccagccccacagccctgggggaggatgtcagctgagctctggctattaagttactattgctttaaatactcctttaaacccatgacccatctagcagctctcagatggcatataaaatgagaggaaaagagcacctgatcgggctgacatcaagagatcacaagtgtttgcaggttttccagagtgtttaggaataaaagagcagtgagtcaaagtgtgtggaagaaggagcaggagcagaggaaaaggtgttggtcccagcgggtgggaaagaattaacagtgcggagagtaggggggaggaaggtcagttttgtttgcacgaaacctgcctttgtggcctgggatatgactgtaaaatgtttaaccgggggtcaaatatgggctttggacaaaggtagaagggggcagccggtgaacattggaagtgttttaatctgaaatagcctctcaaggtggaaggcaggaggaggtgaatacgaggcaaagggaagtgggtcttgggagaaacctggtcagcagggcatccctcaggtcgggggcagggcctccgggtgtttcaggtctcactcattccatacacactggaacagttccctgccactgctctgcaaatgctgataacagctccacagtaagtagagggatttggagtgagcctttagaaacagtcacaaccatttgacgatgcctgttgaatctaactacaaacaaaacccggagcttgtattttatatgtctgtatatattttcatttaatttctctagaaattcatttttgttgtatattacaaaagtatcagtgtgcagcacactaaaaaaaaaatgtgaatgaagtgactcatttgtaaattagcatcatgggtgccttcagttc

SEQ ID NO: 1765 - DNA, 10194 bp, Homo sapiens
ccggctttaggagttttattaggtgccctattatggaaaataaactttaatcccaccataaaaaccaaatctgaaaaacatacttgcccttgtggtcgggagcgccgcggcatccctggtggaggtcacacctccgacgggattagttttaaggagggagacagcgctccgcaagactttgataccggggggctggggggcgcccccttcgccgccgcgccccacgcgggtcccagcgcccctccgcgccgcactcccctcccccggacggttccgcccggcagccccctccaagcctggggcgcactcagcgctgccctccgctggcgggggcgggggcggggtgggggagggaagggggaggccgcgggtcagttgacccggaaacctgagaggtgctgaggaacaggcccgggcgcccctccggagcagctcagcaaggaggggctggggtcggaggcgaggagagggagagcagagggaagaggaaaaggaaggaagaaaaaacaacaaaattatttttacaatcattgtgaccattcacgtgttagtaccggagggttaactatgtgcattatgcaacagacgctagaactttctcatcttcccaaactgaaactctgtccccaagaaacaccgactccccagtaccccactccgaaccactagcaacccccattctactctcttagagtttgactcatctaaactgatatttcacacgatcttgcggcatttgtctttttgttcatttgcttgcttatttattactatttttttttagagatgaggtctcacactggcccaggctggagtgcaatggtgccatcatagctcactgcatcctggagcccctgggctcaagccatccttccgcctgggctccgcagtagctgggacggcaggagggcacccccacgcagggccactgtttgtcttttgtaattgggtatttcactcagcataaagtcctcagagttcatgggtgttgtagcatgtgacaggattttcttctttttaaagcctgaatggcgctccaccgtatgtgtgtaccacattttcctcatccatttctctgttgatggacacgtaggctgcgtccacctcttggcaattgtgaagagtgctgcaatgaactcgggtgtgcaaatgtctctttgagatctttttgttttttccaattcttttggatatatacccagaactgagactgctggatcgtatggtaatttgactttttttttttttttttttttttttttgagccctgtcgcccaggctggagtgcaatggcacgttctcggctcactgcaaccttcgcctccagggttcaagcacttctctgccccagctcccaagtagctgctactacaggcgcccgccatcacgcccggctaattttttgtatttttagtagagacggggtttcaccaccttggccaggctggtcttgaactcctgacctcgtgatccacccgccttggcctcccaaagctctgggattacaggcgtaagccactgcgcccagcctgatttttaattttttgagggaaattctgtactattttacataatggctatgccatgttacattctgaccacagctgcaatttctccacattctcaccaacacttgctattttctgtgctttttgtttgttttatattggccatcttagcaggtgtgaggtggatctgtggctctgatttgcatttccctgatgcttattggtgttgagcatcttttcatatgtgtgttgccgtttcaaaattttatttggagtcatatctattcaagtcatttgcccatttaatttggttttgttgtagagtgctgagagttacataatctgaacattaacccattccctgattcgcgtgttgcagatgatatctcccatccccaggttgcctttcactcttgttgatcgtcctttgtggcgcgtacgtttttcagtttgatgcagtcccatttgtctatttttgctttggttgccttgtgttcagtatcaaagaaggaaagtcaccggatgagggaagggacaggtccacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccccgggtcgcagtgacggccgccgcaggggtctccccccgcgtaccttcgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccccgagggaccaccgccccaggccgagccgagtcagcgaccccgagcgcggcgcccaggggtgggggtcgcgcccgcaaggcgggcagagccgggcctcgagaccgttcattaggcagaatgaattgttcaccgtgcccggagtggatgaggacgagccagtgattatatttaaatttgctataattgatttggggaagagctactgtgacaagaacgaattgatcattaaatttattagcgagataaattccgcggcgactgagcggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactcttccctggctgcccagtgttggtgagggcgctgaggctgggccggctgagcccaaggggaaaataatccccagatgtggggccagccaggggagagattgctgcaggctgaacctcaccaatgtgttagaaattaaaaagaaatgtagggattgcagattaaaaaaaaaaaaaaaaaaaaaaaaaaaagcatctgtcttccccccttccctctggttttcccaccctcttcctctgggcactctgcctcctccaccagtggcaaaccctctcccagttcccctaaacacctttggaccccaggcggcggaggcccggcccctgcgccagcgcccagcagctgcttctgcccggactcccagcagccgcgccccggccttggatgaggttgattttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggagcggcgtccccgtcgcccgtctcctccggggccaggagaggccactgggtcatcgatgggggaagggggccgggagtcgcgccgggctgggtgggccgcgggcctgcgctcctgggcggacgagagcgcgggctgagcccgcatgtgtgcagcacatggcgctgggcctggctgcggtgattgatggcgcgcgctgcagaggctgattaacccggagccgctgcagccgcggtgtggagcgctgctgcagtccgccgctgtcctcgcggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcccggctcctccgcgccgcccttccccgcgcccccgccgccgcccttctgtttctccgcttcctgcgccgcctgctctttggcctttttgctgcgtttccatttcatccgccggttctggaaccaaatcttcacctgcgggcacaagcgggcgtgagaaaccggccaccgccaccccagggcttcctgtccccggagtcccccggccgcgtgcgcctgggccccattgggtcggccctggaatggcctcagggtgagacgacttagaagcagaatggggagggggctcgtagcttcctcctccccgcaaccccccactcagcagcaaaccccagagctgggctggagctccgtgggagctaggactatgtccccaacgacccaggccggggacttttctacccgcgccctccgtctgcggaggaagggtcagggcagctggctacgtcgcggtaaatctcaggatgttccctcctctctttctggaacaaaatttctcgaatgcggcctggggatcaccttcttcagaatgaaaggaggggtggttaagtgctgattcttgggccccacccgaagctactgaatcggcgctctgggcaccttagatgaacccgtgcgcccgccgtctgaaccgtcgaggcgcagcgctagatgcctcagaccgcccgtgggtcacaagtgcaaaggtaacagtgtcccctgggaggccgggatgcgtcgggggcggggagggcgcgcacctgggtctcggtgagcatgagcgaggtggccacctcgaagcgcttgggccgcgacaggtacttgttgagcttgaactggtgctccagctccagcagctgctggctggtgaaggcggtgcgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccaccaagtggaaatggatagtttggagttaatgagaccaatttttttttttttttttgtctaggagacgtctgagtgtccctgttaaacagggcccatcgcaggaggcttcctctccacaggagccggctttggtagcagtggattgacccagaggcaagaggagaactgaggccagtcgggggccaggaagggaggttccgggaagcccaggagttgaaggctgcagtgagcgagactgcacccctgcactgtaccctgggtgacacagcaagaccccatctctcaataaataaaaaataataaaataataaaataaaggagcagtgagtgatgagaaccaaatctctccccctctcctcactgcgccttcctagagattcaggctcagatccaaacaggtctgggaagagctggtcctgctgttccaggtctccctgcactgcctccttaagacagaaaaggaggaggaggaggagaaaaagaggaaggaaggaagggagagagggaaagagggagggaggaaggaaagaaggaaagaaggaaggaaggaaggaaggaagggaggaagggaagggagagaggacaggtggaacaggaccaaacccagggtccaagtctgtgtattcaccagggaccctcccaccttccaaatgttttccttggcatgccccctcctcagggtgcgggcggcaggggcaaggcctgaggagactagaagccttttcaggacaattctcattacgcaaattacaggcagaggcgcaggcaggatccggttctctgtgtgttcaaggaggcctgcccggctttatttacataatttcgcacggttacatcacagagaattttatgacctcaaaacgagacttcccttgatttcccaggagcctgacaagtgttggacaataaaagaaagaaagcaaaggaaagaaaggaggccagccccaggcctggatgagctcaggtcccccgggatgggcagtttgctttagaggatggcccacgccccctgctttagtcaaacaaggccccgaattcccaacttgacaatacattagaactttaattaaaccactggctccggagggaccatttgggaaatgccatccaacaggcagagacaaccaattaaagaaaccaaacaggttttccccggaccagcgaggaggacttctcagaacacattccgccgtctttggcacggttatgcctgcccttttggattgccaggtgcagatacctcttctgaacttaagactggttgtgtttaaaatttggccaactctaggtcaacatttggaatcagaaataggcaaggtgtctcactttaataaattttctgagtgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgaggggcagctttccctcttccagccagtcagtagggctgactctcccaggtgagggatgggtgaccactggggccttcttggagctgagctaggaaagcctggggcggctgtgggcaaacagccttctgcagggattcttctcaccctcttgtgacttctccagcctctggggtcctagattttctctgtttagtcacaaccacagcttccagcaaaggaatctgaattctggagtgtttatttctgttttcttttttgcttttcccctgctctgcctgcatctccccagtctaaacaaatccactcagacagaaacaatggggtctctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctccgaagcccatttctcttgtttgctgctcctgaagcactccctctccctggaggggccgcgggtctctctaacgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccattttaataattcgctgcccgtctcatgcctgggggtccgggcgagtcctcgcaggccccgggcagagccgaggcggcttcgcagctcttcccccgctcgctgggagccaagcgcagagaggggcaggcggtgccggtggaggatgcgcgaggccctcccgccacgcgcatccacgggggccgcagggtactcacagttgaagtcgggcatcttaggcaggatcatgcccgcggtggacgcgcgcagccactggtccagctggaaggtgccggcgcccagcttgatggggtcggcggggtgcgcggggtgcgcgccttgcacctgcgggtacgagtaggagagcgccgggtgctggcccgccagcgcagccgccgccgccgccgcggagtagccgtagaccgggtggccgtagagcgccgcctgcgccgggaggcccgcgccgccctgcgcgcccccagggtgcagccccagcgccaggcccccagcggcggcggcggcggcggcggcggcggcagcggccgctgcgcccggatgcgcgtggtggtggggccccccgtgcccgccgcccgtgccgccgccgccgccgcccgcgcccaggaagcccggcttgggcagcagcgcgcagtgcgcggccagcaggcgcggcggcgacgggctctcggcgcgcaggcggtcggcgggcgcagccggcggctccgaggacgcggggctgcagctgccgctagtcccgccgctcgccccgccgccgccgccgccacctccggtgccagatgcggcggcggcgagcgacgtgaccaaggccagcggcgcgctctgcgcagaggcggctcgtggggggtccaccgccagcagggcgtcgatgcggaaatttttggatttttccatcggctcgtttggggctggcgctcagggcccggtggcgggcgacgcggccgtgtgcgggctcgcggagtcagtgcgtgcggtgcaagcccgggggctcgg

SEQ ID NO: 1766 - DNA, 4774 bp, Homo sapiens
ccggctttaggagttttattaggtgccctattatggaaaataaactttaatcccaccataaaaaccaaatctgaaaaacatacttgcccttgtggtcgggagcgccgcggcatccctggtggaggtcacacctccgacgggattagttttaaggagggagacagcgctccgcaagactttgataccggggggctggggggcgcccccttcgccgccgcgccccacgcgggtcccagcgcccctccgcgccgcactcccctcccccggacggttccgcccggcagccccctccaagcctggggcgcactcagcgctgccctccgctggcgggggcgggggcggggtgggggagggaagggggaggccgcgggtcagttgacccggaaacctgagaggtgctgaggaacaggcccgggcgcccctccggagcagctcagcaaggaggggctggggtcggaggcgaggagagggagagcagagggaagaggaaaaggaaggaagaaaaaacaacaaaattatttttacaatcattgtgaccattcacgtgttagtaccggagggttaactatgtgcattatgcaacagacgctagaactttctcatcttcccaaactgaaactctgtccccaagaaacaccgactccccagtaccccactccgaaccactagcaacccccattctactctcttagagtttgactcatctaaactgatatttcacacgatcttgcggcatttgtctttttgttcatttgcttgcttatttattactatttttttttagagatgaggtctcacactggcccaggctggagtgcaatggtgccatcatagctcactgcatcctggagcccctgggctcaagccatccttccgcctgggctccgcagtagctgggacggcaggagggcacccccacgcagggccactgtttgtcttttgtaattgggtatttcactcagcataaagtcctcagagttcatgggtgttgtagcatgtgacaggattttcttctttttaaagcctgaatggcgctccaccgtatgtgtgtaccacattttcctcatccatttctctgttgatggacacgtaggctgcgtccacctcttggcaattgtgaagagtgctgcaatgaactcgggtgtgcaaatgtctctttgagatctttttgttttttccaattcttttggatatatacccagaactgagactgctggatcgtatggtaatttgactttttttttttttttttttttttttttgagccctgtcgcccaggctggagtgcaatggcacgttctcggctcactgcaaccttcgcctccagggttcaagcacttctctgccccagctcccaagtagctgctactacaggcgcccgccatcacgcccggctaattttttgtatttttagtagagacggggtttcaccaccttggccaggctggtcttgaactcctgacctcgtgatccacccgccttggcctcccaaagctctgggattacaggcgtaagccactgcgcccagcctgatttttaattttttgagggaaattctgtactattttacataatggctatgccatgttacattctgaccacagctgcaatttctccacattctcaccaacacttgctattttctgtgctttttgtttgttttatattggccatcttagcaggtgtgaggtggatctgtggctctgatttgcatttccctgatgcttattggtgttgagcatcttttcatatgtgtgttgccgtttcaaaattttatttggagtcatatctattcaagtcatttgcccatttaatttggttttgttgtagagtgctgagagttacataatctgaacattaacccattccctgattcgcgtgttgcagatgatatctcccatccccaggttgcctttcactcttgttgatcgtcctttgtggcgcgtacgtttttcagtttgatgcagtcccatttgtctatttttgctttggttgccttgtgttcagtatcaaagaaggaaagtcaccggatgagggaagggacaggtccacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccccgggtcgcagtgacggccgccgcaggggtctccccccgcgtaccttcgcttctgttgaaggcagtgagatccgcaggcctccgggacagctagaggacagcagacatgtcccgtgggggaagcctgggcctgtctgaaaacaccgcctcagctccctccggggtccccctgcgtagacctggcttcaggtccggagaaccggattcttgagggctgcaaagactttctcccccatgcgcggggtcagctggcggctcaggtgcgattggaggcctgggccccgagggaccaccgccccaggccgagccgagtcagcgaccccgagcgcggcgcccaggggtgggggtcgcgcccgcaaggcgggcagagccgggcctcgagaccgttcattaggcagaatgaattgttcaccgtgcccggagtggatgaggacgagccagtgattatatttaaatttgctataattgatttggggaagagctactgtgacaagaacgaattgatcattaaatttattagcgagataaattccgcggcgactgagcggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactcttccctggctgcccagtgttggtgagggcgctgaggctgggccggctgagcccaaggggaaaataatccccagatgtggggccagccaggggagagattgctgcaggctgaacctcaccaatgtgttagaaattaaaaagaaatgtagggattgcagattaaaaaaaaaaaaaaaaaaaaaaaaaaaagcatctgtcttccccccttccctctggttttcccaccctcttcctctgggcactctgcctcctccaccagtggcaaaccctctcccagttcccctaaacacctttggaccccaggcggcggaggcccggcccctgcgccagcgcccagcagctgcttctgcccggactcccagcagccgcgccccggccttggatgaggttgattttatggaaggggcccggggtgataatgagttgccagagaggatattaatctccccgcgccctgaggcagaggagtggctgcgctcgccccgcggtaatcacccaaatgaaacgccaggcccttctgaactcattttatccgctgggaggaggggaggggaggagggaggagaagggcacacgcaggtgctgctgagaaagtgacaaacagaaggaaggaggaaggcccgggagaagggataggagcggcgtccccgtcgcccgtctcctccggggccaggagaggccactgggtcatcgatgggggaagggggccgggagtcgcgccgggctgggtgggccgcgggcctgcgctcctgggcggacgagagcgcgggctgagcccgcatgtgtgcagcacatggcgctgggcctggctgcggtgattgatggcgcgcgctgcagaggctgattaacccggagccgctgcagccgcggtgtggagcgctgctgcagtccgccgctgtcctcgcggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccg

SEQ ID NO: 1767 - DNA, 5704 bp, Homo sapiens
acagagataggagggtattagaagttagagatgggtatgtgttataatagtctgggtcaggcaagaactttataaaagctcagattccggggtaacacccctggaattctgagtcaatgggtgtaaagctagtcctcttaattctagatgaaatgctaaacatgaatgactggtaggaagttaaagcatcaaagggagaatatccttgatgctgacccttttagaagaatatcagaaacccataaaaattataagcagatgcttcatttttaccacaaatggatactgactcacctggatcagggtcatattttaggtccagtggatgtacaacagggtggtactgcttctaaacataacataaattaaaacagatttaatcacttaatgcttcatataaacatctctttcagctaatatgggagatatactatagagtcagtaccattcttttgaggaaaaaaaattaaatcctactgtctgtagggaagaggaggtgagaaggtaaaaccaaactaagtctgaattatgtcttttacagtactgccacctgctgcatatactaagaagtggcaccataaaaaagtataatcagaaaaagcaatcaagcaaattaaaagcatagaaactgaattttatgtttaaagtacagggtagtctccaattatgaagggactgtgtttcaaaagttcattcaggacaagtgtttagaactcaaaatgcatatttccatgaaaactcagttctaaaaggtggcgaggctacattaccaccacactaagcctatatatcctgcgacacactgaaattatagtagcagaattactggcacagaatctacaatgcaggcaaaaagaaagaggaaattgctcttccttattcttgcccaaagccagcagaagccaaaaaggttaaaagaaagaaaacaagaagaaaaaaaggtcttcagccagctgtggtgactcacacttgtaattgcagcactttgggaggcccaggcaggagaatgtcttttgctcaggagtctgagaccagtctgagcaacaaggagggaagaagggaggaaagacgcagggcagggcagggcaggaaaaaattttgaaaaggtctttggtatcctcaccttatctattttgcattactttttaaactaccacagcagtacctcacctaggccagccatctttcttttctgcaatattgattactagttttgggggtttaggggtagtggggcagtaacaagggcaacactgaaaaatacactttcaatgtttttcctgaaaaaaactttcaagtgggaggggtgggggaagtgatggaatgcggtatttgagaactgctataaagaaaattaaaaattctgctcatgaatactgtttttcacagaataactaaaatgttttagatacaatattaagccgggcatataatgacctgaaacaatcctgaaactgaggcaactagaagatttatatgtgaacatttatgtactaatttcaaaaactaaaggcaatagtatagcacaatctaaacacaacatgtacctcactggagggacaatgctattcccagcaaacctcccctccccaccaagggaagatttgggtccaattttcttgtggatttcctattttttatttattctagtcctaataaatctgaaaagatgagggtgtgatatggttggtcattgatatctatagtaattataagaaggaagtctacggctctgcttgtctaaaaagctcgtgctgaaggagctgaattcctggtcttgtcacccagatgttcatgatttttgcagcaaaacaaattacacccaattcataaagcaaatttcagtgttatgaacaggtactaaaacaatcttcatcatcaatttaactaaatggtcttccaaaatatacaaacatacaaatatatgccaaaaaaaaacaacaaacagaaagaaaagtgttaaaagaaaagcttctttttccatccttgtctcagaatcataaagtcattgtcagtcttccatcaccaatttcaattttaaccactcactataactttcatttttttcatttttgaaccagtgtgttcaaaacacagtatagtatgactatactatgtcatagtacaacttagaagagtaaagtcttacaagagacaaacaatactaattgaggcaggaaagaaaaagacaacaaaatgtcacttatctccacgtagagccttatattttaatgtttttattgtggtaaaatatactataacattttaaaggcaaatcatcttaccagaatttcttgttttgcttttatggttttgatgacacattccaggatctttctgggatactgcttacgttttgtggctatatctactatgatttcatcaaactgatcttcaagtactttgatgtcagaatctatttgagaaaaaaaaatgtatatataaaaagttccctaaaactcattgtttacattctgtatggaaatgtgctataaactaaatttagaaaacacaaaataatgaaggaaaacaaatatggcaagttaatgaatgcccccactttggtgattaatttatttacgcattgaacaatcaattattgagcatctataagaagccaggcctaaacaagagaaatacaaagatgagcacaacatgattcctactctctaagagttcacagtttgctgaaagaaacagacaattgcaaggcaacctgataagtgcaatagaggtatgagcaaaatgccatcaggacacagaacaatggaaaactgactgactgtgaaatataagactttaaagaagtaacatttgagcttgaaatagaagtataagtccaatggataaaaagtggtacgggaaaaaaggaatagggagaagcattttaggcagtggaaacagtatttgcaagatcctagtctttggagacctgagaaaagttctaaatggctacagaataaagtaaaggagaaatggatgataaaatatataagaaccaggctgtaaagggtatttaatatcagggatgctaagaagttttgacttattatgaactgacccaaagctatgacagtagcagtgagtggagtaactagatctgaaataggactcaactggattgatggtaggaaaaactgaaagatacagtgagtttagagtttctttcatttagctaactctactttatcatatgctttttcatgttttaaaacagtgattctcaaatgttagaagaatcacctaacgagtatgttaggagtacagattttttttttaatactttaagttctagggtacatgtacacaatgtgcaggtgtgttacatatgtatacatgtgccatgtcggtgtgctgcacccattaactcgtcatttacattagatatatctcctaatgctatccctccccactcccccgaccccacaacaggctccagtgtgtgatgttccccaacctgtttccaagtgttcccattgttcaattcccacctatgagtgagaacatgcggtgtttggttttcaggagtacagaattttgattcagtaagtctgagatggggcccagaaatgaagcaccctagatgaaaggaatgtaggtgatccatctaactttattttgaaaatcattttaaagagtaaaaatactaagtagttacaaatactaaagagctaagttcttagcttaactggtcctcatattgctctgttgtgtcaaagtctaagctagaaatggacctatttattttattgatcagaagctttattaggaagaaatctaacatctgaaacataatttttgaaacattttgagaaattgctgatatgtttcggtatatacatatcagataatcaagtatatcaggtatagtctttcattcatgtcacaaatattaattgaatcccactaaattagttcttttgagggcaccctttttttcctttttctctttctttccttccttctttctttccctttccttcccattcattctccctcccttcctttccttcttttctttcctttcctccctccttctttcctagatagatagatagagagagagacacacacagattgattttcaatagcttttggggtacaagtggtatttggttacatggatgaatagtacagtggtgaagtctgagattttagtgcactcatcacccagtagtatacattgtgaaagtacccttcttttgagggcaagaaataatagttatttcttactttgaataattatttatataagcagccctccctaaattttcatttatccattaaaaaagttaaataattagcctgaagaaaataatgtactatttcacaattagttaaaaaaaaaaaaaagaaaagtctcccaggtaaatcttttttgtagagaggaacatgctttcttagcactacctagtgataaagctacaattaaaatgtatcacaaaatttgaacagaagccaggcacaggcctgtaatcccaacactttgggaggccaaggcaggcagatcacctgagtttgagagttcgagaccagcctggccaacatggtaaaaccccatctctgttaaaaatacaaaaatgagccaggcgtggtggcaagcacctgtgattccagctacttgggaggctgaggcatgagaactgcttgaacctaggaggtggaggttgcagtgagctgagatcgcgccactgcactccagcctaggtaagagtgaaactctgtctaaaaagaaagaaaagaaaaattgaacaggaaagaattattcattaatttaacatatttcataggtgcctactatgagccaagagttgagaacaaggtcaggagcagtggctcacatatgtaataccagcactttaggagattgaggctaggagtttgagaccagcctgggcaacatgatgaaaccctgtcctctaccaaaaatacaagttagccaggcgtggtggccacatgcctgtaatcccagcaactagggaggctgaggcacaagaatcactttaacctgggagacagaggttgcagtgaactgagactgtgtcattgcactccagcttgggtgacagtgagacttcatctcaaaaaaaaaaaaaaaattgtctttttaaggaaccttctacaaagatgtaacctcatcctttacacggtacttgtataattaataataacttcacacttttaagggtacttcactattcactctagagatcacttacaaaaatacaacttgctttgtaaataattacagaaattccctgggcctcttttgtcatctggagatagctctacagtattttccaataaactattgacaaagaagactattgaagtcataatctcagttctttattactcccctagtaaacaacttcttgaaaataaatgacactaaatatggagattaaaaaacagcattcaaaacaaaattagctgcaaaaataacccagaaattaataatggaaggaaaaagtcacatacccataaaacaattatctgaagcttcctgccatgcttgcccattaatgctgatattctcttgcacagctgattcaaaagtctgcaataaattcacagtagtcaagtcactaaaaataattttaaatactaaattcaaacgttttagcaaaataatacttccagatttgtgacagaggaaataaaagtagcagaatagctaattagtatatctattcttttcaat

SEQ ID NO: 1768 - DNA, 10846 bp, Homo sapiens
cctttgttaaccagtgtgtcatataacagcaatcattttctgtggatgaataatgagggagatggtaagaagcatgacctggagtagactgcaccgccatccgcctctccactttccctctctcactgcatccttccttctgactgcggcagagacaggccgaatcactcccctgtgagaaacctctggatggggggccatcccctcaccaccctgaggaccaggtccacattccttactgtggctgacaaggccctccatagcttccagtgtccccttcccgcctccactcctgtgttcgtgagtagaattcggtgctccagaaacatcacgcctttctgcagccctctcctctattccgtgctgtttctcaccccagcttcttggctcacacggtttcacttacccaatacgctaataacatggaggttaagaccagcggtggcatcaggtaacccggttcaagtcgttgctctctgtcacttgttcatggtgaaagcactcaatctctctgaaccccaatttatacctcagctttaaaacaagtacctatctcagggctgttgtgaagatgaaatgaagaaaatatgcagacataagtggttgctttctttatccatcttgcttaactgccctaacccccaagaagtcttccctaaccctccttctgaaggaccctgtgcaaaactctgcaggcgccatgcgctgactgttgtctgattatttctctgccctgcttggctgaggtctcccaggcatggagtccctttgagattcatctccagcctgggtgggcccactggggcccatctgtcaaggacagagcaggaggtcctccggagaaggtgacaacgtagtggggcatcgaccataacaaatgcgggagctccagggaacgacccccgcccgctggcgtctctccagtctgagaccccactggaggagctgtccatgtggctgcctctcgccttttatcccaggggacagagccaacgccaagcatggcaaccacccaccttaacctaatcaggatgcagcctgctcattaattcattcattcattcagagggatctgtccgggtgcgggtccagcacgggtccaaatcctgcatctccagtagcctcctgggggtcggtcgtcgggagggctcgtgagcggaaggctttaggatgaagcgacagggcccagagtcgtggagattggactggggggcaggggagcaggcattgacaaccacgccgacaggggcatcccgcgcgcctgtgtgggagaatgtgtagggcaagcagcagggagagaccatctcagagacaggggaacagccaagcagaaaccactgtgctgggcgcggggggaggccgggaaagacagcacatctgcggggcgggaggaggggagggaagggagtagaaacactgctcccgccagccgcgggtgatggggacacgtgtccagctcgctgagtccgagggcctgggcccgctttgggtgccctgtttctccggcgcccaggtgtgtgcgcagaaccgtgtctgctccagggacagccgtgaacgagcgccgtccggagtggcagggccatcaggtgtggctcattccaagaaaggtccgtaccttcacatgtaaacttcctggcaaagctgctgggttgccgcttatgggagaaggcggcgggcccaaggttcggcccctttgtctgaatctggcatttggagcaggctttaagacttcgggaaaagccgggcccctgtgcaaccaccaaaggctgcttctcccgccctcaggactaagatcttgttccagtcctccagtcctcggggtctactccaggggtacaaggtgagagtggctctccagagtccatttgccttttggtgccgcactgcatcctcactttgaccctgagcgctgcagtaagccctgcagggtgctccaccttgaagcacgggaagatctgatgctggccgccttcttccttcggttgcctgaaagggcccgtgtttatccttcgcttcacagagaacgcaacacacaacattaaacacacatagagagtgaaagagaacaaggcatcttcatcaaggagggcgcaccatttaaccacccgcgaccttgcagtgcgcctctgcaaagtggggactccgctctgtagcaggagatgggggtgttgacgattttgaaagtagttctcagttttccgaggcaaaggtgtctggggctgacgaatgacttttgagaagaaggaatgatgagaaatgtcctcattacagaactttcccggccacactgtgagtcccacgcaaagaccccatgaccaccaaccggagcgctgggtgctccctggcagggtcacctttgctttttgcgcgcccccatgccacccctggggcaggaggccatcctcttatcctgggagtgcaggcctggcccgaagtgcagcccccgaggccgggagccgagattcttctcggcttcgtgctcagagctttgcagcgtggcatggtttcctcctcttgccctgttgctgtttcataccagggggaactgagacccagtcgggttatgggcctccctgagaacactggcctctagcagaagcagattcaaccccaggcctcaacctgcgcccagacccgtgccctggagtggagtttacccactgccgcccttcctgggcaaatgtcaccgctgcctccgtccccctaggtccggggcgggtcagtgcttcgagccagcggaccccggcctagggacaggtgcctgcgagaatgcggggggcggcccccagctcccctgccctcctccctagaggctgggcctgctggtctcccggctgcgcgcaaggtgggaacgcggccgacttggtccgctcgccctccccgcacccgctcctctggagccgctggggctgcgcaccgactcacccgcgcggcctccgggctgcgccttcagcgctggcggcgtcctgcccggcgagggccagggtcccaggaggccccggaggcggcgggaccgcagggcggaggggaggccgtgggagcggccgggcgcgcctcagcagcgcggagactggggccgccgccgccggcgcagggcgggccgggagggaggaggagcgcgcgggcggggccgccgtgtacgtccccgcgctcccgcccggcctggccccgcggtcccggagcgagctggggccgcgctggggagggtcctgggggcgccgccgtccctcgggccgggcaacgccgggcggggaccggtctcgccccgccgcgctcgggctccctccccggcggcccctcctcggcgaacagcctttcggcgcggggggctgttaaaccagacaccccaggccacactcctctcgttcgaaatgaccatttcggggttctccgtggcggggagctccgccgccgccgtcccccttccacgcgcgggaggtcggcgagggcagggcggggacccggagtgcggcccccggtcctgcttcgtggcccgaaacgcctcgcaatggagtcactcatgacaggggactcagcgcacggggcggctgctgagccccgcagcgatcggcgggcgtgaggggttccccggcgtggttgcccgggagcctgtcagccccagcagccctgacaggaaagggaagtcgagaggaggctgagcgaacggccgccacccccgcgggacgctgacccgggcggaccccgaggggcctctccccgcgccagagcgcggcgtgcgcggggaagcgcgacccaccggggtcggcgacggcgcgcggggcgggcgcggcggttccctctcctccgcccgtgcccgtgggatcggcgggcttgtcgggctgggagagcctcgtggaacccgggcatccgggcagcagcggcctccgagccactgtggaggcgcccggggtcggcacggcgaggccgacggggacctgacacggtcacgcggcgccggggagcaggttcgagtggccgggcgtggccgtgctgcccctccgcgttccgcaggcggcgacgggcgagcggccctagcgggctgcagggaggacgccgcgtggacggagagccggcgcccgggggccagatcccctcccgggacggggcgccaggtccccgcgagctgcggcgcgacgcgcgggcacccgtgtcccacccggtggcctcgccgctgcgggctgcgctgagagcggggtggcgcgacgcggtccctcaccgcagggggaagacggcaccaccgcgtcccggccgctggagcttcccgcccgcgccgccggcccgacgctgccccctggcgggagagcgctgcaggggccccggcgaggccgcaggacccgacctccccgccggcctcgcactcccgcgccgccgccgagggtcggcagccggatcgccctccgtgccccatagcacccctcacactaaaaacgacgactttattaagatgtgaggtattctatacatacgataaataccaggaaatttaagtacagtacatggaagtatacagttccatgaattttttcctttattttttagatacagggtctctgtcgcccaggctggagtgcggtggcacgatctcggctcaccgcagccttgaacttctaggctccagcgatcctcctgcctcagcctcccgagcagctgggaccacaggccccgccaccatgcccggctcagttccatgacttctgacacgcgaaaccaccaggctagtctccccccgagttcaagaagtcctctcctcccaaaagtaccctcctgcccctctgcagctaacccctcacctcccctccgccctggttccagacaactgctcctctgatttctgtcactgccctttgcctctctcgcaattgcatgcaaggagaaccattcaccgtgtggtcttttgtgcctggctttcttcgcttggcaccatgcagctgagcgtcgcccgtgtggcgtgtgtgtgttgtattttcctctaccttggtcttgagacctccctggagagccactgtaaaggccaactctgccctgacagggctcctgggatttgggcgtgggtgtttgccgtgggcctttcatggggcacctctgtatcctggctgacctgtgaccgggtgtccctctcccaggagacatatttatcctggcagatctccttgtgcttcttgtctgacctgtatctagtttattcctaccaagatagctgctctctagggaaagccctgaccagggaaaacgttacgtttgagcgtctcagtcaggcatgacacagagcaggcaacacaacgaaacacaggaactaacagaagtggtcctattacttacagatccacaggggaagagggcacactgagggccgtcgggaatgtcttggggacactgtacacaatcgttgtgggggtggggggagccagagagagacggacctgtgggctgaggcttttattggagtgcagggcattactcaagcagttttcccaaggggagctctaattggttcacctagaggagcgaactggagtcctgtggggccaccttgtgacttaggggtggtcactgagacatatctgcatagtccatgcagggtgtgggcgtcagtggggtgagtctagttggttgtatgtatacatcccacaaggaggcagttaccaggaggtggctacctaggaccagatatctggacggaatgtgttgagatactgtttccagcagagagctggaaactgtatccaaggtgactaagccctgcttctagtatgaaattgttaaccctatattcaaaatggatactgaagcaacctaaaatttcaggtatttactaaagtgtgtatcaagttccctccttaccactggtgagtagtattccattgtatggatatgccacaggctgtttgtccatttggacattgatggatggactaaagttggccaagctgggctggtggggaggcaccctctcaggaccccaaaggaggatgcggggttgttgttggatgtctgggttgtttccagtttgaaggcattgtgaataaaactgacttgagccttcctagaaagttttttgaatatacatatgtttcatttctctcggataaaatgcctggaagtaggcgggatggcttggttgcatggtgagtctttttttaaaaaaatttatttaattaattaattaattaatttttttgagacggagtcttgctctgtagcctaggctggagcgcagcggcaccatctcagctcactgcaagctccgcctcccgggttcaggccattctcctgcctcagactcccatgtagctgggactacaggcgcctgctaccaagcccggctattttttttgtatttttatcagagacagggtttcactgtgttagccaggatggtctcgatctcctgacctcgtgatccatccgcctcggcctcccaaagtgctgcgattacaggcgtgagccaccacacccagacttttttttttttttttttttttgggatggagtctcgctctgtcgcccaggctggagtgcagtggtgcaatcttggctcactgcaacctccgtctcctgggttcaagtgattctcctgcctcagtctcctgagtagctgggattacaggcttgcgccaccacacccaactaatttttgtattttgggagagatggggtttcaccatgttggtcaggctggtcttgaactcctaaccttgtgatccatccgccttggcctcccaaagtgctgggattacaggtttgagccactgcgcctggcagcatggtaagaaattgtttttcaaagtggtcatactatttgacattaccaccagcaatgcatgagagcccatagcattctatggtttgtcttttcattttctttttttccatgagacagggtctcatgctgtctcccaggctgcagtgcagtggtataattgtagctaaatgcaatctcgaactcctgggctcaagtgatcctcccacctcagccttctgagtagctgggatgataggcacacgccactatgcctggctaattatttttatttcaattttttatctttagtagagatgagatctcgctatgttgcccaggctggtcttgaactcctgggctcaagtgatcctactgcctcagcttcccaaaatgctgggaatacaggtgtgagccaccacacccacctgttttttcattttcctaatgttatctttcaaagagccaaagtttctaattgtgacagcgtccaatttattaaacattttccttgattgcctaccttaaggtaaggttgcaaatattttctcctatattttcttctagaattgtatagttttggctttttgtttaggtctatgatacactcaaactaactttatgggtggtgtgaggtaagaatcaagggtcttatttatttatttatttatttatttatttaagatggagtctcattgtctccctctccctcgccctcgccctcgccctcgccctcgccctctccctctccccacggtctccctctgatgccgagctgaagctggacggtactgctgcctgattctcctgcctcagcctgccgagtgcctgcgattgcaggtgcgcgccgccacgcctgactggttttcgtatttttttggtggagacggggtttcgctgtgttggccgggctggtctccagcccctaaccgcgagtgatccgccagcctcggcctcccgaggtgccgggattgcagacggagtctcgttcactcagtgctcaatggtgcccaggctggagtgcagtggcgtgatctcggctcactacaacctccacctcccagccgcctgccttggcctcccaaagagccgagattgcagcctctgcccggccgccaccccgtctgggaagtgaggagcgtctctgcctggccgcccatcgtctgggatgtgaggagcccctctgcctggctgcccagtctggaaagtgaggagcgcctcttcccggccgccatcccatctaggaagtgaggagcgtctctgcccggccgcccaacgtctgagatgtggggagcgcctccgccccgccgccccgtctgggaggtgtgcccaacagctcattgagaacgggccatgatgacaatggcggttttgtggaatagaaaagggggaaaggtggggaaaagattgagaaatcggatggttgccgtgtctgtgtagaaagaggtagacatgggagacttttcattttgttctgtactaagaaaaattcttctgccttgggatgctgttgatctatgaccttgcccccagccctgtgctctctgaaacatgtgctgtgtccactcagggttaaatggattaagggcggggcaagatgtgctttgttaaacagatgcttgaaggcagcatgctcgttaagagtcatcaccactccctaatctcaagtacccagggacacaaacactgcggaaggccgcagggccctctgcctaggaaaaccagagacctttgttcacttgtttatctgctgaccttccctccactattgtcctgtgaccctgccaaatccccctctgcgagaaacacccaagaatgatcaattaaaaaaaaaaaaaaaaaaaagatggagtctcgctctgttgcccaggctggagtgcagttgcatgatctcggctcactgcaacctccgcctcctgggttcaagtgattctcctgcctcagcctcctgagtagctgggattacaggcacccgccacaacacctagctaacttttgtatttttagtagagacagggtttcaacatgttggccaggctggtctcgaactcctggcctcaagtgatccactggccttggcctcccaaagtgctgagattacaggcgtgagccaccgtgcccggccaaggctcatttttagatatagatctagatatccacttttctagtaccatttgtcgagaaagctatctttaccttgacacctttgtcaaaaatcacctgtggttaatccagtgctggagataagcaggaggtgctctgggtgccttgagaagggggcacccaattaatccagccaggtctagtccaggaagccttcccagaggggcaacaaaggaatccaggcagagggtctgttggtagcttagagttgtgtttttgtggattgtgtaggtatagcggggtgtggggaagacgtagagctagaagtaggcaggacccagattggggtggggcggggacctcatgtgctttgctaaggagcatgcactttttcctgggagtgatgaggggccaccgagaggcttaggcagggaaataacacagccagactctggcagtttggaacattgactccggctgaggaggaaggactgaaggaggttaaaatggaggcaggctggccagtaactgggaggtgatgataggaagggaaatttcctctgattattctttttgttttctcttttagttagaggtggagtctcactaagttgcccaggctggtctcaaactcttggcctgaagcaaccctcctgccttggcctcccaaagtgctgggattataggcatgagccaccatgcttggtctaccttgttttaagagttgactttcgtatcatgctggagaatgacctattctaaataaatgccgtggaattcagtaggtagaagccacaggacttggtgactgttttggagtgagactgacagaaagatgttctgtctgggggagtggttctcagccttctttcagactgatcatgctggacttcctgccagaggctctgtgtctgagggccagcagggaggcccaggcctccgtgttttacaggcctccacggtggcttctgatgtacagccagcattgagaaccactgctccaagttgacagcagatctcatacttggcaaatgggtgggtgatagttccagtcccgacacagggagcacagggggtggagcagatttagggggagtttaaatttggttttaactacttgacactttgaggtactgttgggagatttccatgcagaggaaagttgaatgtgtgggtttaaagctcagaagggaaggtggactgggaaaacagtctggttggacatcagcacatggagcaggggttaaccaggagcttgtaaacccagggagttatacagacagttttatgggtatgcatacatgtacactgtttttcctggggcaaatagggtttctgatttcccagggcccatgaccccacaaaggttaagagcctctgatgaggacagtggttgatccatgggacaaaataatattactgtggaaccctgctggggcaagaagggaaaaggccccttcttttctctggcccagctggcaggtgctagctatctgcctcccctcaggcccctgcctgccagggatctatacctctctagctgccacagcaacgctttgtcaccctttaggttcttgtgtttgatcgaagtcttttctcctttaatttacatttttaaccaaagtaatatatgtgcacaattgtaaaagttaggatagatacacaaaacttttttttttgttttgttttttttgagatagagtctcactctgtcacccaggctggagtgcagtggtgcgatctcggctcactgcaacttccgcctcccaggttcaagcgactctcctgcctcagcctcccgagtagctgggattacaggcgcccaccaccacgcccggctgatttttgtatttttagtggagatggggtttcaccatgttggccaggctggtctcaaactcctgacctcaagtaatcctgcccaccttggcctcccaaagtgctgggattacaggcgtgagccaccatgcccggcccacaaaacttaaaatgagaaacagcccc

SEQ ID NO: 1769 - DNA, 1480 bp, Homo sapiens
tccttcatcttatttaattactcaaaacatcatggcaaatctgttgaaatcaaagtctcattaccttctgcatatctgcttgatcctttttccgagcccacacaactgtgatcacataaaatcctaaaaggctggccagcagtgacaccccaacaggattgttggtcacgcgaaggaacagtttgatcgtgtcttcaacattcacggtcctgggcacgacaaagaagtcgctggcaaagaaggtcaggtggttacagagacactgtgtcctcagaattgtgctctgtggcccaacctggaattagaatcaagacgttgattctagtcagacagagtgctaaggaggggacagacataaaacaaacaccagcaatttagagatggaaagaggtatctggttctctcattcacagctggtgatggcgtaaattggtataaccaatgtggaaagtaatttagcaacatctagtacagctgaagcagaacaaactctttgaatcctgcaattccagttctgagtgtatacatgttctaggggaactgtgcacatgtgtatgaagatatatgaaaaggaatgttttgtcacctttgtctataattatcaaaaataggaaacaacttacatgttcaatagcagaacatacaaatgaacaagtacataagtaagcagaggcaaactgattgaattctatacagcagttaaaaatgaatgaatcagcgggtgtggtggctcatatctgtaatcctagcactttgggaggctgaggcaggtggatcacctgaggctaggagtttgagaccagcctggacaacatggtgaaaccccatctctactaaaaatataaaaattagccaggcttggaggcgcatgcctgtagtcccagctacttgggaggctgaggcaggagaattgcttgaacctgagagacagaggttgcagtgagcccagatcacaccactgcattccaccctgggtgacagagcaagactctgtctccaaaataaataaataatacataaatataaaaattttaaaaaatggatgaattagaggtagatgtatcaacatggataaatgctaagtgaatacaacaagagatatgtacagtataatgccatttgcccaaagcctaagaagcatgcaaaacacttatttatctattcattgtcagtttccctctccagaatgtcagttcatgaggcgattgtcttgttcactgctgtgtctctagttcctagacttgggcatggcacgtagaagacactcaataaatattcggtgaaagaatgaattcccccctcaaattcaggccagtagttaccctttggtggaagggaaggaaggagagagactagagagggatactcagagggcttcaattattcatgagtgttttattatttaagaaaatatgaagcagagcaaaatactaactttgataaagctgaatgtgcattcaatgttttttattattcttta

SEQ ID NO: 1770 - DNA, 1150 bp, Homo sapiens
aatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttt

SEQ ID NO: 1771 - DNA, 1614 bp, Homo sapiens
gaagccttttaagtgctcttcatgaagttgtcatacagtatgaatacacaataagcgtcattcattaactctacattaatctgacagacattgtacttcacataattactgcctgctgcattacctttgtcctttgtaagctttaatttcacatgtcaacagcaatcactttagagtgttatatttgtagatacagaaaaaggcttgccatggcaaatatgtacttgaaaggtaagccataaactcttgcacttttgtttgcctcccagcttattatagagttttaatttaattttattttttataatttcaacttttagacttgggggtacatgtgctggtttattacatgagtatattgcaggatgctaaggtttgggatacaaaagatcctgtcacccagtgagcatagtacccaacagttagtcaacctttgtccacctctctccctccccactctgggagtccccagtgtctatcattatcaactttatgtccatgaatgcccagtgtttaggtcctacttacaagtgagaacatggagtatttggttttctgttcctgcattgattcgattaggatgatggcctctagctgcatctatgttgctgcaaaggacgtgatttcattcgttttaaggttacattgtattccacggtgtatgtgtaccacattttatttatccagtctaccggtgatggacacctaggttgattccatgcctttgttactgggaatagagctgtgatgaagatacgagtgcatttatctttttggtggaatgatttattttttggggatatatactcagtaatgggattgttgggtcaaatgggagttctgttttaagttctttgagaaatctccaaacagctttccacagtagctgacctaatttacattcccaccaacagtatgtaagcatttctttttctccacagcctcgccagcatctgttgtttttaactttttaataatagccattctgactgttgtgagatggtatctcattgtggttttgattagcatttctctgatgattagtgatgtagaatattttgtcatgtttattggccacttgtatgtcttctttagagaaatatctgttcatgctctttgcccactttttatgggattatgtgttttgtgctttttgaactgtttaaattttttatacattctggttattagacctttgttagatgcatagtttgcaaatattttctcccattctgtaggttgtctgtttgctctattgatagtttcttttgctgtgcaaaagctccttagtttaattaggtattatagggtcctgcaagcttgagttttacttgtataatttttcctgttatattgttgtaaataagactatttgctattttattaatgaaatataaagcactgtgatctgttattaaataagcagattctattagaacttctatatttttcacaataatttcctatcaattccttaggttttaaatgacagccatactatagaactatttattttgcatattgaagatgtaagctaatttgatgccttcagatgcaggcctgagtctgttttcagtggaactctgttttattaaaaatcatattgaataaatc

SEQ ID NO: 1772 - DNA, 12575 bp, Homo sapiens
atgacctgcggtgatatatggcaattgttttactgattatgtttagaaaaatccccaacgtgttcaatttcatattaaaatgcctagtatttatggtttataattatcatttttagtgcaatcttgcgcaacaggaatttcattttttataaagttatttgtcacagtgggaggatttgttttctctttagtttatattttataacaattgcaacccatgatttcacagaggagactatgattaggtataatacagattaacctattaagaaatacttgtaaatcttacaattgatcaagattattttgttatgcaaaaaaatagaaaattttattattattgaaagtgctatcatcatacctttaaactttataattgtatgtatttttcctttattcaaggaagattatttaaagtagtgtaacatacctacatactttcaggagctgggcagcgacataagtgaataaatgagtctgttggggaaggtgtaggatgattgcattaacctgcttttagtttgacatagtaacacctacctcattatatttactttcttattctgggggtgtgtttgtttcgatttaatttaattttttgtaatttattgtgactaattgtggggtacagagttatgatatatgtatgcagtgtggaataattaaatcacactaacatatctatcatcttaaatattaattatttaatctctcaattgcaactttccaccctttgataacattatcccatcccaattcccatccccttaccaccaatctaccctctgctactatgagttcaacttttttagattcctcatatcagtgagatgagtggtatttgtctttatgtccttggcttatttcactcaacataatgtcttccaggttcattcatgttgttgcaaattatagaatttccttcttttttcaaggctgagtaatattacattgagcttacaaaccacattttctttatccattcatccactgatggacacaggttgatttcagatagtggcttttgtaaataatgctggagtgaacatgggagtagatatctttttaattcctcatgatatatacaccaaagtgggattgctggatcatatgataattctagtttcagtttttctttctttctctttttttttttttttaggaacttccatacagtttcccataatggccatactattttacactctcaccaacagtgtgcaagggttccctttctttacattgttacacatctgggagacaaacagaacatgtttatggggtgtagtgggcctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacat

SEQ ID NO: 1773 - DNA, 11283 bp, Homo sapiens
cctcagaaagtcaccaactatagcctcctctattacgttactcagtaagatagatgctcccagggagatgttaggtcaatggtatctgccaacttttcattagaaagtattaccctcccctcacaaaggcagtttagaaatacttcatcatggaagtgaaataaaatgctgtcataatttctctactatgacatatctacctcagtctcttcctgttcaatccatatacacattacccttgccccagggttatctttagatacatgagtctttttatgtattctgtaagtagttaatggatttaattcaatgaaatgatatcaccttcaaaagaaaatctaaactcttagactattactaaagcagcctttgggaagaccctccagcatctccctctcattttcatttctccctgtctaccttccttcacgccctaatatatagaaacacatctcattcacttccccactaatgtaaattgagcaccacaaagaagtcaggcactatgctagatacaagtgttaaatatgagtgaacgagaaagacttcatcctactcttggggagcttcacagaggctagtggggttgacagatattaatcaaataattatgatgcatgccgtggaaaagtttaggtaccatggactgtgcatcagttttccaagttgctttttactattttactcatacctgccctttccatctgtgaaaccttcactcaaccctccaatcctcgttgatttacctccttgggacaattattataacttgtatgcatttctcttattcaaaattatcctaatgaaatgggttgcttggttgcttatatgttttcacatgagcaattgctctattttctcttcctttgcagatatagcccttggcgaggtgcctggctccatagtaagtgttcaacaaatgtttgaataaaatattgcattgttgaattttaaatgtatttaagcaaattgataaccaacatctgaccagatttcccaaatttagatgcaatgtcagatgcttcttttaatggtgtcagagattggctgacaggcttgcctgtctttaaagtaatttattacccatgttggttttttggtataaatggttactgtttgtcattggagtatgtttgtattcatggtagagattaaatacatatgtattgcatgaattaacaaatggttatgctagttgtaggaaagattgataagtgaaagtttctaatgctctttttttgagatggagtctcactctgtcacccaggctggagtgcagtggtgctatcttggccaattgcaaccttcgcctcctgggttcaagtgattcttgtgcctcagcctcccaagtagatagaagtacaggtgtgtgccaccatgtccagctaatttttgtagttttagtagagacagggtttcgccatgttggccaggctggtctcaaactcctaatttcaggtgatctgcccatcttagcctcccaaagtctaatgttctttacaggcctatgagtattttatgccagaatattgattttattggagaactaaaaattgatacaatccatagcttgaaagtaaaaatgtcaaaatacttaagaccatacacaaataagtattctaaaataaggaattgatatttataaaatatttttaagaaataaggacatttggccaggcacggtggttcacacctgtaatctcagcactttggaaggctgaggcaggtgcatcataaggtcaggagttcaagacctgcccggccaatgtggtgaaacctcgtccctactaaaaatacaaaaaaacttagccaggcttggtaacaggtgcctgtaaacccagctacctgggaggctgaggcaggagaatcacttgaacctgggaggcagaggttgcagtgagctgagatcatgccactgcactccagcctgggtgacagagcaatttaaaaaaaaagaaataaacacatttaccattacagtattttttagccccccaatcttgttattattaataacaataataaaataataagcccttgacttctttactttgctgtccttttcatttattttgcatttcttcattttccttgtgcagattttatactctgctatcctcagccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacat

SEQ ID NO: 1774 - DNA, 9163 bp, Homo sapiens
agccaccctatccgtatcatttctatggtatctctgacctcaactatgtttagatttctccgtcttcccctaattactggcatcttccttttttatgtgcttctgctttctctgattttgggcattagatccttcctaatctgccctctctaaggttaatatcctgttcttcttggttagttaggatctcttcccatttagttttaatctaatatatccttcttctcgtctctcaaactagttttgcccattgcttcaccttggttctaatccagggaaggacataagtccctaatgtctattttctgagcagacaaaataaaatatgcataaactgtatctgaacattttagtcctctaattatttgtgctgtttcactgcaactgaaatgaaaaactccagcctctgcacaggattagcatcagcagctttgcctcttaggctctattaaaagaaaatctgtagacaaattaaattcagcaaagcttgctatttgagtaaagaacaattcatgagttgggcagcacactgagcctgtagaggttcagagagctctccccagtagtagatagtatttatagacagaaagggaattgatgaaaaaaacccagcttgataggttaaagtttagcatttgctttttttgggcatggtgggacaagacatttgccttatatggacctaacctgatcagttggcagcctgtgatggctggagtttggctgctgtgattggctgagacttagctatttgttggaggaatatactattaagttagattacagtttatttgcatactaagtaaggttgcaatttgctacatatataggcagctttaagacaaatttaatttaacagctctattgccaaaatcacttctgaggaagtaactcactatttggtatctttgcaccaggctatactgtcaaaaggtatggattttcagagacagagtttgctgactgagtaatgactgagctgaaagttggcttgcatgcactttttctgtattttctacttacattgttgcatttcacttaccttgcaagagctcactgcatgtcccactgacattcattcctcccaggctattttgcacccccattcccatcagcatcactttacaaagtgggttattttacccagccagttgtccatttaatgtacagaagggtctgtataaagggtctgatcaaatcattgcacaatgcccaggcaattacaccaccaggaacaattactgctttatcgaccgtaaacatttttctgaagttaaaaataacaagaaaaccatattccagcagtttctcaaaaggtattcaatttaaaaatttaatccaatactacaaatatttatttagaaccaacttttacaagttctgagcctataatagaaaattgtgagggaaaaggattatggtgtatgtatgttcgggtggtgtatgtgtgtaaattatcataagatgcatggaaagttttgacatttctgggccagggttagggttaggtgagttaaccataggttaactatgattaactaacctgtgattaactcacctatggttagagttgccctcaattgtaggctaagttattcaggcaaccctgaaacaggctgggtagggaagagaagcctaacaccactggtttagatttgctgcttaaggcttgggacaagtgtgcctgagatcaacctatggatagtccgaggtccagggaacagccattcagaggcaatttttcttggctttccctggatttaccttcctatttaagttttatcatatgtccagaccacacttagaactagaaccaacatttaaaacccagtttatttggctaggattccaggtactctatttaacacttaccacccatccctctccagggctaggtctacaaattagatgattcattcagaaaaatgctattgcacctttcttatctttataacagcaacttgtattgtgaattttcatgagtacttcacgtagattatacccagttctcacaggaacattaggtattacagtttaagaaactgaacaaggggaagagctgaaatccaaacacacatcagtctttgactaaattttggttatcataagttcctgagaactactgctgtcccctgcctaccacactggacatctttggttagtaggtcatccttatgcagttacttgagcttcaaattctggagtctgccttgatattttctctccccccacctacccttatattcagtcattatcagtcattgttcttaattgcaatcaacagatgcaaacacttaagtatcaaatgtgttcattataatatgcttattagaatacagaattgacaagagttctgggaagccaagtttgaggctacatcttcaagagatatgcttagaagcatatcacaaggctggccttatatgaacatgagcctagtaactaccatgcaatgagatggaggaatcacccatcaccttaatgaggttaggcctgagccaagaacttgaccttgcatcattttggtcatcattgtctctgctgctgtcaccaagtatatccagacaccactgcacaactcccaatcccccagcaaaaatataaacaacttcttcccattactcccatttgaatacaagtgtctcttgatttttgcatttgatttctggagcctaggtcatatgtctgtatcacaacagcaaaggaatctgcttatttcaagttgagcttctgaactggaaaggtagaattcacagtttgaaaatatattcaggtaccaaatggcttttcgtaagacactgggcagccccatgtatgaccaatatccaccacagttggctaggcctatagctttattcccccacataccctgacactcccaatatcttctgcagtcaaccagttcacagggatctaaaatgcacatcaggctccaaatgtgaatgcttataacagtttgctatactgcaaaactgcagaaatagttgctgttgagtgctgtttttcaagtgtttttgtaaaatgaagaatttttttaaatatttgcctatgaatttagtttgctttatttttcttgttttataatgttcatttgaaatctgtattgtccctggtcgagacagtactacactggtctgcttgtgggttccagaatgaaataaataagtctgtaagaaaataagcaactaagtaaattagtaagtaaaaacaagccatgcatgtattacctcagaaccagggcactagtaaacttcacaaagccacgttaatcagagtgctacaccatttacagtgacaagaggccccttctcattattattgggacaatactgccaaataagcaaaacacaaataaaactgtccagtggaaattggctaagagtaattaggggcaagtagttttatgtagactaaaatactataattagaagggaggatttggagcactatttgaaggagagaaatcaatagaagagttgctttctatgctccgaagagctttgccagctatctttgttcagtggtaaaatagaattattttacagtaggaaataaacctgggcactaaggatctctgttggggagatacctgggactgccttggataaggagggggtgagcggattgtggcatgacattgtttttcataacatgttaatagcaaaacaaaataccaaaaataataatgatgaataatttattcctgtttgttctcggttaactcttctttagaactttaaatatcaatatcgaacagtgttacattaaagtaaaatgtttatttataacagacaaaaccagttctatactaaataataacttaatgtcatcttgaatctgattaagtagttattttgttaagaatgttctaaactgatcaataagaggaaaactttaagtattctcatatattacttttctgaaactgtcatgatattaatattatgtacttatagttgtggtttgttcctcaaactattacttaatgtgatttattttaaatgtgaattttgcctttagacattcattttaaaaaatagcctattctttattatttttacttagaatttacagaatcctgtggtacagagggacttttccagctcccaggggtgcataaatttcctttttctgtattactggctagttgatgattgacttgcctctgaattatccctaccatgtggccaactagatacccttcaatatggcccattttatctttggacagttctgatagtctcccatattgttaattcgattttttttctcttggcagcttcattttatttgtccttgttaggtctcttaagactaccttgttttttatttttatttgttttgcaaggatggggtgcacaatcagtggtacagtatggttgttccataactttattaaaaggcatataaagtacttgatgctacagagtatctagaaatatgcgttgtgcttattcatttgtgacaataggtattttggcatttttaatacattcattacatttgcaatttaagaagcaaatgaattaagttcatgatgactgaatgggatgggagttagagtttgtaaggtgacctggagaggttaatttcacagcgtgcagtaattgtgaatttttagatggaaatatatgtgtgtaaacctgaatcttaccccacattggagacgaagctgcagagaaagttgttcttttgaccttaaagcaagttaaatttggagagctgcccaattaagaaatttttatccacaatatatttttaatttaattcttactttgtggggatattaaagactttttttcccctccaatttgctatttcagtgctagtaatataaatccattgctaaatccagaggaaaagatttcccatgctttggattttacccggttagttctccagttatactcttaagtaatttagaacctctgaaaaaactgaggttaataaggaataagaaattaataatggaaactaataaacaagagatatggaaattaaaaatactcaaaagaaacaaatccttgaaaatcccaacatacagggttcaaataaaattaggatatttgaagggccatttaggatatttgttatgcttttgtaatattcctgagagtgtataccacttttgttcctattttacaaatgaggaaactgaatgtcagacaacttaataactttcccaaagccacacaactaacaggaggtcaagactgaatagtcagactaaatctggaattaggccgtttttagaaactattaatgaaatggaaggggaactgagatccatcaaatgcaaaaatgaaaactatatcataagtaatctgctggcatttgatgcttatttatttctcattacaatcctgtgggttagctattgttatcttcctttttcacataatgaaacacacgtttggaaaggttaaactatttccccatgttggccatggggaactgatagtcagtagacctagcatttgaacattgagctctggactgcaaatcttatgtcgtttttttactctgcaaaaaattgtaaactctttttagtaagaaaatactgtatttgaataatctatttcatagaaacccaagttaggtaaggtgccaattgccgcgacccctgttggaccacccctagacgtttccaggacacctgcggacttgaaagtgcccatgctaccatgctgcctaaagtcattctagttttttgaaactataattacaaataatttcccagatacaatcatattaacatatacatacacagtccctcccatgttactgtcattgattcaacatatgtttattgagcaccctctatgtcccggactgtttcgaggtgctggggaatataaagatcaaattctggcccttcatagaacttgcatggtttttactcccatcgtttagcccactccagtgagtcattcactgtactgtcttggtgatatctgtaaactttccatctcctactagcttttaagcccccgtggtacagaaagtgttttattcatttttgtgtctcccacagatcacctgccacagcaatattcccagtgcatctcttcttttacactattttcaatcacaagactataacatgcagcttcgtaaaattcatcccttcacctaaatagattccagctgtgacaatgtttataatttccctgtagcttgaaattttcatcaaatttctacttttagatatgcaaatttacgattaatcaatgagtcactgagaaagtatgaatcattttttgttcacagcacgtcaagatatgttacaaggtgcaagacttaacattaactgcctttctaacttatgaaaaaaacattttaaccacctaaaaagggtgttttggtgagcatttgttagaggactgggagttgtttctctgagcagggttaatagagctgagtaattttttacttataaagtcctctaaaaatataaatatttttgtctttatttgatagtgtcataaatgtctttgttcctctttgaaagccattatataacaaaaggatcattttgagtaagagatttttgactttaaagcatatagttatttgttattggatatcccaggatatcttttgaaagtctggagttgttgtcaatgactcacagtgacaaagtgcttttgtgtgtctttatttgcatgcctgagggaatcactatttttaaaaaatagattttttttttttcacacagccctttaaaagaaagtgtattgtggctactgaagaaattcccagagcaatgttaagaattacaatttgcataataataatttttcctttgcctcaactcagtgaaagccaccctgattaaaaacagtttgctggaagttgctagttactagaaggcacttgaactaaatgtatttggcaaatttgtaacccaattctgggatgcaactctttttttccctaaggcccatctcagcataattctcccttaaagtaaaatataaaatcaactctagacagctcttaggagtttttactggatgcttttggtgtgtgatgggattgggattagacaccatacaccacaaagtaaaacttctgaagaaattctcttccagctttatctggagtcagatccttcaagacaactctccacagctctatttccctgatttctcctcagtcactttttgaaaattctagctgtagcttcaggactttctcattccaagttggcccccttctcctacattctgaattattctttttctatggcatgtgattcattcttatataatttaagttaacctcttaagacttctagtgtttctctacattaaatatctaagtcaatacaacggaatcctgggagccaagctgagcaaaggaagagtcctccttagaagacaggggtagctaaaagcttatgtctatttatactttgggatttttatgtttattacactgagagcttaaggtttcagttttcttttggttaatggttctttagaaaagccgcacaattaggacctcacaaaatagctctacctgggtaaatgtaccaccttcctgcgagaaaccctcagctttgtaatgaatcctgcatttttgtcagcataccaagagtgcttctatctcatgcgcatcacaaatatacaaccaggatgtaaaatcacagtaataatttactttggaaattatgacttttgagaggacaagactctgtgtttgatatgtctacttcatttcctccatgaagaagacgtaaggagagagccaaattttactctaggaaagttatttgatatatctagaatcataccaaggggtcttaaaagttcattcttccattgtttctatcactgcaaattcagtacttaatctgagacaaggactctgccgggaactaggactataatgatgaatatgtcacatcagctgccccatatcgcatagtttagtggcagaaacagtattaaattaagaactcaaactaattcagaaggaagaacagtgttcagtaagagtggataacttgtggctttccaaatatatgggttaggaaaagcttttccaaggaagtggaaagtgagtttgtatgtagtttgtatgtaggaatggagacaacatagctcatgcatagatcatgggattgatcttatgtaccagcataagagtttaaaattttgtttttgagcaaaaggaatttatctttttctaagaggaccaatatggtcaaatttgtattttaaaatggtaagtatgcgatataaagagaatgtggtagagggtgaaggagattcagtaccattaggagatgatagcaggaagtgcagatagcatgggatggtcactaggcttatgaggatggaagtggaaagtgagaaatctagatggatttcttcatttatgtgcagtcaaatcaagagcacttagtatctgattagaagttggaggtgaagaggtagtgataaaggtgactctgaggtttttggcattaacagctaggtgaatggtggtatgaaatatagaatgatatggtttggatttgtgtccctgcccaaattgcatgttgaattggaggaggggcctaatgggaggtgattggatcatgggggtggatttccctgcctgctgttctcatgatagtgagtgagttcttgggagatctgatggtttaaaagtgtgtggcacttccccccttcactctgtctctctcctgccaccttgtgaagaaggtgcttccttccctttcatcttctgccataactgtaagtttcctgaggtctcccagtcatgcttcctgttaagtctgtgtaaatgtgagtcaattaaacctcttttcttcataaattacccagtcttgggtggttctttatagcaatgtgagaactgactaatacataggtaataaccaggtttgaaggtaggatattaaattcagttttgtatcagttgcaattgatttaggctgcataaacttaaaacagtaatagttgttgaaaccatacaaactccccttctttcacatatcaagaagatcaagagggtagttccaagacgatacactggttcaggcccttttattccatgcctattgcctcattgctacattgctacaaaatggctacaacagacatcatgttatcattaaaggcagaaggatggaacaggaaagtattaacat

SEQ ID NO: 1775 - DNA, 3118 bp, Homo sapiens
aagattggctccaatctcagattttcgctcaaaatgctacaaatgtccatattttagagccctgggtgtgctgtacttgcttttgcaactctggtacatttgtgggtttttttgttttgttttgtttcctcagagtaaaagcactgctgtgtagctcttgtaaaccacagggctgtgaacccacctggccaggaaattgcaggcagcacagttgggagttgaattttcttctcctctgctgccagacagatctctctacagcactcctttaatcatgcatcctcccctgtgatgccagagctcctgggacacagagtgcattgctttacaggctgctttccacagccaaactgggtttgagtggcatagaaggtgtgacattcaaaatcttatgaagaacaaggagaggtagtggggaaagttctagattaggagtctggtgcagctgcagttcaatctgctgctaactctcagacagtcctgtctgctgctggggcagggtatcacctcttttgctggttcaatgcttggcacgtgggctttgctcaataggaaaggtggttatagtgaactgaactaacagtacaaataagaaagccatttaatttctcagtatctcaaacatctatatatacgaagtgggaagaatggctcctgctgtgcttatttcacagggttgttctgaggatctcaactaataataactaccaaaacactttttggtggtatggtgcttatacttgggtaatgtatggttatgtccgttcacttgtcaaacataacagactgttttctttatctcctgaatttttattcaatggaacagtaatgaatccctaaatcttctaaatgtgaacagtaaaagagacagaatgacttttcctggcagtctgcatgccatgactgaattatttagacttctatttaaacctgatgaggaaaaaaaaaaaaccctaagaataaagatttgtcttttaaccaattatttcagaaaaatgtttcttttagacttattcacatttagaagatactattgatagtgtggatgtcctattataaattagataccatttccatatcaaagttaaatatatctgaaaaatgacagagccagcagggattgctagtggtagagtaagttgcaaatgtcagtttattgtagcagtgtaaattatatttaatttaaaagactacgtttaacttttaaaatgagggtactccaagttgaatccatggcaaataaataaatataaaatattttcctaaacatgtcagggtatctcataaagcagtatcctagaggagctctgatttgctggatgctaatagatatatcgtccaaaatatcctaaattcatgtatatgtaagaacatttgagttaaatgcaagtgaatctttttttgcagttttatctgttaagtgtaaatagccaagaaaaggatataatgtagcatttttactaacagttttactgtgataaatttgtttcacgatacctaataacatctcccagccaggcgtggtggctcacacctgtaatcctagcactttgggaggccaaggtgggtggatcacgagttcaggagatcaagaccatcctggctaacacggtgaaaccccatctctactaaaataaataaataaataaataaataaataaataaataaataaaattagccaggcatggtggcacacgcctgtaatcccagctacttgggaggctgtggcaggagaatagcttgaacccgagaggcagaggttgcagtgagctgagatcgcgccactgcactccagcctggcgacagagtgagactgtctcaaaaaaaaaaaaaaaaaaaaaaaaaaaactcccaaaacattgttctgataaacaccattttataaaatgtgttggcaacatgtgtttggttagacttactggagcccaaagttatgccttttggtctgtataaatttaattaacaatagacttattgagcatctattgcataaacaacagtgcgtggggtgctgaagggcataagaaactgagtgaaattatgactgccctttagaagtccaaagtcaaagggcacccatactcagtgtcatggaaatggtataataaagtaggtgcgaggtgggagagtcacatctatttgggtgcagaattgaaagtatcttcccaagagtcaaaagcatgaaataatagaaatccattgtgatcacctttaatagtatgcttacaaagattggtcaaataaatgtagttacatggctggttagtattctggtggatgacactttggaatagcacccgtctccatttgcttcatctcatttgcctcaagttagaataggttcagctcattgacttttttcagttccataagtttatagttatatctgtcacggcatcatggtattgcttattcagttttaaattaaagaagaaacaaaaattggctaaatttttgagagcagttaatacatttttaattaacttactgtgaaaagatacagttagtagcccaacaggatatttttcaattgtttgaacctgaggtttaatatcagagggataattttggagcaaattttactttttttatacttttttcatgctaacttgaaatattgaaacttcagaatgagatgggtctattctctgcttagagagaatcatgacaaaatgcaaatggcccttctcccttcaagtgggggcgtgccaggcatcaattagccacaggtagagttctcttaacctgtggtttgttctcttctgctttatccctatggctggaatggagtgagagtagctagcttctccacgcagatgtgatgtgtagtgcacccaaacataaataagtcttatcaaaagaattcatttaaatggtgcctgtttggttttatcaatcctcactcagaagaacataattctaatagccagataacaacgtggaccagcctggtatataggcatctgtaaaggtacttctgcacaatgactacaaatttaactaggctttttgaaatatgccaaaagcatttattgggagtgattaaacccacatcatttcttgagaacagtttaagagctctgaacgttgatattttgtataaatctctttgtaaat

SEQ ID NO: 1776 - DNA, 1824 bp, Homo sapiens
ctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcacc

SEQ ID NO: 1777 - DNA, 3519 bp, Homo sapiens
ctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcaccgcatcagcatatttctgctcattgaagaattcataaaatgtagccatgtaggactccttaaaactcgcctaaaatgaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagacctgccagtgcccgtgaggtctccaagcaccctttggcatcagtgactccgtcctggccccgggctgtccctcacacctgggtcccaggctcatgaagaggtacgttggggcccagatgtggctgcctgggaacctggagtcataggccagggtcccagagcccccacgcccatctctcgcccgtggggcataagggccgctctgaggtgggaagagggggcagggacctccatcacacggggaagtggaggcacccagggattcgggggggcctttgcagccaccattcctgaggctcgaccccaagttcctgttgtttccacactgaggtcactgcacagttccctggctgtgaaatgaggtgggtttggtgcagacctcggaggaggctcaagtgcctgttatggagtttccagcccacagcgcagggcctggctggtgggaaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagatgcctgagggactcctgacctggtggcaccagatccagtctgaagggacgaggatggaggacggaggttcatatccacagggagagaggggccctgggaggagggggccgcgtggggaggggagcgccacgttgggaggaggcggccgcttggggaggaagcgccacgtggggaggaggcggctgcgtggggagggaagtggggaggagggggctgcatggggaggtagtgcagcatggggaggagggggccatgtgaggaggagggggccgcgtggggaggtggggaggagggggccgcgtggggaggagggggccgcgaggggagtagggggctgcgtgacgaggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggggttcactttaggaggggagaggtgagcgggacggggacgctcaggtcctgggtttcaagagaggatgtggtgccggctttgattcttgatctttatcttacgactctctcaaatgtggg

SEQ ID NO: 1778 - DNA, 4267 bp, Homo sapiens
tctgattgattttctaaagcataagatgtatctcctaagaagtatacaaaagagcgggttaattatgcctaataattaacttgcatactgaaataaaggtagagcatcatttaaattgtaattttctgtatttaggctgtttgtgacattcacatttgattgtaataatacatttttcttgggccaggcgcggtggctcatgcctgtaatcctagcactttgggaggcctgggtgggcagatcatctgaggtcgggagttcgagaccatcctgaccaacatggagaaaacccgtctctactaaaaatgcaaaattagctgggcgttgtggagcatgcctgtagtcccagcaactcgggaggctgaggcaggagaatcacttgaacctgggaggcggaggttgcagtgagccgagatcgtgccactgcactcccgcctgggtgacagagcaaaactccgtctcagaaaacaaaaaacaaaatgatttttctggaatcctaattctcttttgtttcttaggtgttttattgtttactaaagctttaaaaaattacttccttcaaaaacattttttaaaaaggtagttggttgttaaaaatgtcaaattagaagatttttttttttttttttacaaggcctggtaactttatggatatgttcctcttttatgtaactatgtatatcataaagtttattttgcatcctaaacatttctgtatctctttgatgtcttggagaggcaattcagcaaactcgttaagcccagtttcaaatcctggttttatcatttactatctttgtgaccttgagtaagttgcttagtctctctgtagctcaatttcctcttctttaaaatgagaataatattacctcattaaggttgttttgagtaataaattaatacatctaaagcatctaaaaaagtgcctagccactagtaagctataaggattcattattatattattgtagttattattgtctcctgaaatttcaaactctgaaattgaacctattaacttcttaaatctgtaccttctaccatccctgtttttgtcaatggagtaacacccacctaatacctagaattgaaaccttcacaggactgactcattgctttgcttttttacatctggttaatcaaaaattctttttctttgaagtagccctttctatttcttctgtggcctctgccctcatccacgctagatcacttcacatttggattattactgcagcctacttgacaccattatgttttatgtttaacttccctaagtcataccacataatgctgctaagctaattttcctgagaaatccaaccatgaaagttccttatgagaacttttcggtggctaccatttctttctgagccatcagtaaacccctctctaggacttctaactcctttttttttttccttttctttttttttttttttttttttttgagacaaagtcttgctctgtcacccaggctggagtacagtggtgcaatctcaactccctgcaacctttgcctcccgggttcaagcaattcttgtgcctcagcctcccaagtagctgggattacaggcatgtatcactatacccagctaatctttttgtattttgggtagagatggggttttgttatgttggctagctgtcaaactcctggccttaagtgatctggctgctttggccttgcaaagcgctgggattacaggtgtgagccaccacgcctggactttttttttttttttttttgagacagagtctcaactctgttccccaggctgaagtgtggtggtgccatcttggctcactgcagccttgatcttccaggctaagtgatcctcccacctcagcctcccaaatagctggggccacaggcatgtgccaccacacccggctaatttttgaaatttttttgtagagacggagtctcactatgttgctcaggctggtctcaaatttctgggctcaagtttctcccacctgagcgtcccaaagggttgggattacaggcgtgagccactgttcctggcctttaactctttcaatagtctacctcttccttcttggcaatctttgtccactattcctcaacatgcatcttctctggtaatgccaattataccctttctgtgcccccgtcatggctcaactttcccccccaatcttctttcctactaatatactctgtcttcacctctttctaggcccaaattctaagtatacttggaagacatgattgctgttttctatctgtctgtctgtctgtctgtctgtctgtctgtctgtctatctgtctgtctatctagagtctcactttgtcgcccaggctggagtgcagtggtgagatctcagcttattgcaacctctgcctcccgggttcaagtgattcttgtgcctcagcttcccaagtagctgggattacagtcgcccaccaccacacctggctaatttttgtatttttagtagagatggggttttgccatgttggctaggctggtctcgaactcctgacctcaggtgatccgcctgccttggcctctcagagtgctgggattacgggcatgaacccctgtgcccggccttttgctctgttttaaactcttacaataccaaaaagcatttgttacataatgacatatacttatatataggcctactgtttgattttttttaatatatgtaaatcttacattcaactgagcttctacagaacggaaatcacatttgatacttaagtaattgtttttcctgtttcatacttagtatctcgctgtattctgattgctatagcgtcttttcatagaacatgtttgttgctcattttttaattatgggaaatctcaaatatatataaaagtaaagaggacagtatatggaactccggagtacccagtataatgaagttctttgtgcttatccctcagtttcaacctttatcaatttatagcggagcctcttttatctatttccccccgaatcagctcttaatattgtttgccttttggacttgtaaatatgaaaaagtggactattccagagtgtgttgcagatggcatatttttatactgttaaatttggtattatgactcatgataaaaattccatcttgtttttaatttaaaaaaaatctggcaattaccatttatttttatattgttaaatttaacattgtgactcactctataaatattccatttggttttaatttttaaaactctggcagttaccatttatttcagtgacttagcttaataaataaattaatttggcaaatatttattgaatgcctactatgtgccaggcatcgtgccagacactagggagccaaggtgaataagatattagatctcatgttttttgaagtccatttttctgttttatttaaaagtaagactattttgtagtatatgagtaaaggccttttagaactgtatttccaaattattattattttttgagacagtcttactctgttgcccaggctagagtgcagtggcgcaacctccacctcccaggtttaagcttgtgcctcagcctcaagtagctgggactacagtcgtgggccccaaggcccacctaatttttgtatttttggtacagatggggtttcgccatgctggccaggcaggtctcaaactcttggcctcaagttatccgcccgcctcggcttcccaaagtgctgggattacaagtgtgagccactgtgaccggcctctaaactcattttttaaagactggtaacgtttctaagaaaattcttgggacctgtacagttagcagcttgttattttgccaggttaaggtctgtatatgaaaatatctaatactttaattttaaaaatatgtttttaaactgaagaaaggacataatctcagaataaaagataatctttttaaaaatttatttaaaagttttaaaatttttagtaggcacaggttcttgctttgttgcccaggctggtctcaaactgtgggctcaagtgttactcctgcctcagcttcccgaagtgctgggatcacgggtgtgagccatcacacacggcctcaaggacaatcttttaattaaaaaaaaaatcttttgtatgtagaggcagggtcttgctgtcttacccaggctgggtgctcaagcagttgtgccttggcctcccaaagtgggtaggattgtaggcatgagccaccatgcctgacttaatcttttaatatttgattttatgaaatagcactacatatcccccccgttttgttgtagaccaataaaaggtgataa

SEQ ID NO: 1779 - DNA, 17531 bp, Homo sapiens
tgttcagggtctaaatctcatgatgttcaagaagtgcttaaaaaaaaacaggtaacagtcttgattcttcttgccttacagaagaaaagatgccttgaatttttaagtggttacattatcacttttaaatcagttcatgttggcagggcataacatcataatgcttatttagcttcttctctaatgtaaacttggaaaaaaaaggtggacatacagaaaaaatgtttcacaattgccattcagaatttttttttgatacactattattccctccaattctagtgtttattttctttttttaattcctaggtagataatgattcatataaaatataagacttttgtaattattatctatatgattcagttctgagtttcattgtcatcctgttaagttcacatagggttttccaaattaaatagatatttatatgtactatctcagtataattagagatttaacaggagggtgggaggcaaaattttcctggtgaaatccatagattttactctcttatttcttatttcttttttttttttttgagacggagttttgctcttgttgcccaggctggagtgcaatggtgtggtcttggctcactgcaacctccgcctcctgggttcaagcgattctcctgcctcagcctccagagtagctgggattacaggcatgcgccaccacccctggctaattttgtatttttagtagagatggattttctccatgttggtcaggctagtcttgaactcccaacctcaggtgatccacctgcctcggcttcccaaagtgctgggattacaggtgtgagccactatgcccggcctactctatcatttctaacctatagctgcatgtcacttttttcttttcttttcttttctttgagacaagttctcactctgtcactcacgttgagtgcagtgtcatgatcatggcccagtgcagccttgatgtcccaggctcaaatgatcctcccaccttagccttctgagtagctgagtaggcatgtgccaccatgccctggctaattttgttcatttttttgtagagacagggtctcattctgttgccgaggctggactcaagcattcctaccacctcagcctcccaaaatgctaggattacaagttgagccaccatgcctagcctcacatttttaaactttaaacttaaaaaataaggatttagctattacattggcaagtgaaaacaactttggtttttcttcataaggacattcaggtcattcaagtcaataaatctcatagatatagctaattaggtccaatattttaaatattttttaagtacagttgtaaactctattatgctgaaagtgttagggaaaatatattcaaaggtttcatctatggtgtcagctatttttttattaggaggacagtctgtctcagggatgacccagaaaaaatgagttgagaatggtggcaaattacattatctgtattaatttcttttttacttatacaggaagcaatgaagttacaacaagatatgaggaaaaaaagacaggaagtgttagaaaagcaaatagaatgccaaaaggtaagacaagagctcattatttgcatgctagaattgatgtatagaattgattttaaaagtattattcataatttttaaagacttctttatattaaagtttattaagcatggttttacctttttctatttatttcgtagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggtatctatttgcattttttatttaacatagggttattgaacatctgccatgtgcttgacaccttgaaagtacaatgggacccttaggtagctaatatcctaacagggatataggcaaacaattatagtacttaaaaaaaaaatcctaattatagtaccttttttttttttttttttttttttaagagacaaggtctcactatattgcccaggttggcctcaaatgcagtcctcccaccttggcctcccagagtgctgggattacaggtgtgaaccactgcacccggctgccacaatttttttgttttagtgtttctgtagatgctctgtaccctttttgggaagaggttgataataccctgtttgaacaaagatgtgttttttaactgaatattttggttctctgctgaagatgacactattaaagtgatggtggtgaaagaggtatttcccatttcagcagtgtttttctaatgctgtaatagtattgtaataaaaccatcctttaaaaaaagaagcctggcctattcatatgggtaaaaatgtggcatgttattaaaaagaataatcagaagttttagatctatttaagtctaatttttattaatttccatgtgtttccttgctgtacttggtttagtcagtggttccattacaccacagttctgtggtgtgattatagataattctagtcctttgagaactggtaatgaatttgtcagatatgtagaatgtaaattgttatatgtagtattacattaaatttgaaattatggttctctatcagtatagaaacataaagtgtttaagatttcttcttaaagatataataaaaatgttttttattgaaatcttttctaattatagaaagaatatatatgcacattttaaaaattaaagaggtgaaaaaatcattggcagtcatgtcttttaaagactgataaataattcgtctctaacaaaaaagagaatgtcaacagttgtggattccaatctggtagtaattatgtagctgttactttgtattataaatacatttttactatataatttattttgctccattgtgtttcatttgtgatactttattatgtgacagttattctcagctccctcatctcaggtgtctgttcctaggatgtaatttttaagccgtctaatgcttactctttttcactgatatctatatactttttacatgttggcactactatatctgtaaagttacttttttaaaaacacccatgtttattgcatcctctcattctcatgttccaaaatacatgtgtgtcattgtgtaactatcatgttctggaggagatcttgtaagttatctaaaaaatacctttttattttcaatttttccaaaggcccagaaggagttattagatactgaactggacctccacaagaggctgtcctcaggagaagacaccacagaattacggaaaaaactcagtcagttacaggttgaggtgagatttaaaaggagttagcgccccaccacatttaacgtctcaaaaaagttttcctttgaccgggcgcggtggctcacgcctgtaatctcagcactttgggaggccgaggcgggtggatcacctgaggtcaagagtttgagacaagcctgaccaacatggagaaaccccgtctctactaaaaatacaaaattagccaggcatggtggtgcttgcctgtaatcccagctgcttgggaggctgaggcaggagaatagcttgaacctgggaggcagaggttgcagtgagccgagatcgtgccattgcactcgagcctaggcaacgagagtgaaattccatctcaaaaaaaaaaaaaaagttttcctttgtttttaaggtttagtctaataatgtatgctacattctactttttgttgttattcaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcagtaagtttttaaaatagcaaatgctaactgtaaaaacactgtgctcatcattttccttgctgcagtgtctataaatgtcagatgttttatagattagaaaaattagttgtaaaaaacatgagtactaccaaatgcctatttaatatatttaaaagtcaagaagcagctcttgcttttgattccataatactccacttaagtgcatttgtagtgacaagttgttccagagctatatttaatttttgttttaggattattacatggcttaccaggcatttatagttaatagtgaaacagtctgggatggaagcaaaattcaaataaagaatttattaggataacaggtatatttagttacattctgtatatagtggcaaccacttacttttaggcaaacatgcaaatagagatttgctacaggcaaatgtctttactgttttggacatatgcagtatatactctttccagccactcattcattcagtaaatattttattgacattatttgtgctagaacattttcatacatgatctcatttaattttaaatgactgtataaatgtgaaatacatgcaaactgtatatacatgcaaaactgtgtacatgtgaaatcctgtgtgtacagatgtgaacaccacaagttaaaatgtcaaccacaatcatataattaataagtagtggaaccaagataaccaggttccctattcctcaaacaactcttttgagaggaagtattttcagtcctattaagttttaaagatggccagggacaatggctcatgtctgtaatcccagcactctgggaggctgaggcaggtggatgacctgaggtcagtcaggagtttgagaccagcctggccaacatggtgaaaccccatctctactaaaaatacaaaaattagctgggtgtggtggtgtgcgcctgtaatcccagcttcttaggaagctgaggcaggagaattgcttgaactcgggaggcagaggttgcagtgagctgagatagtgccattgcacaccagcctgggccacaagagcgaaactccatctcaaaaaaaaaaaaaaagtattaaagatggtgagggaaatcataaagagcaaggcttcacttcaagtgtttttattagtttgatgcccattaaccctgtttcaccctgattcttggggaagataggccaagaaaagtgtccagatttgaatgtcctctgggttgtgaatggttcactcttgacccagttctttccctgatgtaacccttatttgccttttttgtaaagtgggagaatagctctaagtgacttcttgaggagtaaagaagatggaggaacactatacaagtgcagtgtattgtgaaggccgcacgaatgttgatttttgccttttaaggtttagtatataaaattaaaatctctttgccaaataaattggtcttgtagaaccagtaccagttctggtgaggtgatattggattatgtgaagcagaatttctacaaatttgactcattgcagaaagtttcagttacaaaaaatagttaatcttactagggagacagctacatgttctatcctgtggtcactggagactatatgtagatgtttaaattttaacccagaagccatgctcaaatggatctccttccttctgaaaagtagaaccattctaaagcatctaaaaataaccaatttttatgtacatatacctgacaagtctgcagtgtggcattcagttggcagatgtggttatgtctagacacttagaaaagagcaagcaaagctaaggcagatgaggtaacttcaagaacaaaacacttcctttgatttggatggctctttttttttcttttttgatagcatactatcagaaagggtattgagtactaggagcacacttccctgataataactacctgggcaatatagtatgctttctttgaaagaaatacagaaatacatattcttaggcattattgcgaatagagttagcaaacataaaaggaaactcttcttcaaggtcttttgtatctcacagaggccaaggtaaaatctatattttcagtattcttctattcttaatgattatgaaaggatcatgggtgagccatatctatatgagaaaatgatggatggattttaatgaagctatttggaatctaattctggagtccttcagagtttgctcttcaatagtctaagaacttatcataagtggattatggtcgtatgcaaatggcagctataagtatgctcattatagtgcatgtaatagtgaaaaatgataaccatgtaaatgtttgacagtgttttgctgcctttaaaaatgtattttttttgagacggagttttgctctcgtcgcccaggctggagtgcaatggcacgatcttggctcattgcaacctccacctcctgggttcaagcgattatcctgcctcagcctcctgagtagctgggattacaggtgttagccaccacacccagctaatttttgtatttttagtgttagtagtattagcatttctctattttccatacttcctgaggaacacatactcctttttttttttaataggtggttatcttttttttgttttttgttttctgttttttgtgacagtctccatctgtcacccaggctggagtgtagtggcatgatcttagctcactacaacctctgcctcctgggttcaagcgattctcgtgcctcagcctcctgagtagctgagactacaggcacgcacgaccacacccagctaatttttctgtattttttactagagatggggttttgccatgttggccaggctggtctcaaactcctggcctccagtgataactgcccgccggccgcgttggcctcccaaagtgctgggattacaggcatgagccaccgtgcccggcccacacatactacttttaaaatcagacttttttcttcacattcacttttgggatgaagcatcagtgttttatattatgtattttaaaaccaaatttgaggatattgattgatctcgatctttttggtcccaggtacttatatgaaaggtatatttacattaaagcatatacaaatttaaaatacatagaatatttaatttacagtgcaggttatatatataacagcataaaaacatacattaatatataaatatattaatagtatgtatcagagatcagcagactttttctgtaaaggactagatagtaaatactttaggttttttgtgaggagatacagatgatctcctttacattgtcttctctcctttcacctgctcttccctctcttcctctttcctttctagttctttttcttttttttctttttcttctttgtacttcaatggatgaacatatttttcttttaataaccttttcaaaaatgtaaaaaccattcttagctcctgggtcgttaaaaacagggtgctgggctacatttatcctgagggctgtagtatgcagacccctggtatgttattatgttactttatatatcaaatatttaagttaaacataattgaaatatataaatataattttatatattttaaagatcaaaatcagcgaatccagaaagaactttttaattttaatttttttttattttttatttttttggagacggagtcttgctctgtcgcccaggctggagtgcagtggtgtgatctcgactcccttgcaatctccgcctcctaggttcaagtgattcacctacctcagtccctccagtagttgggattacaggcgtacacctcctggctaatttttttgtgttttttagtagagacgggtttcaccatgttggccagcctggtctcaaactcctgacctcaggtgatccactgccttagcctcccaaagtgctaggattataggcatgagccactgcgcccggcccagaaagaactttttaaaaaatagaaaaatctttatttacctatctttatttcacagaaatcttaagatttttaatatcttaatgaagttaatgttaagtatttataattaaagtttaattcagaagctgaaaattttaactcagagccttgccaagggcacagatgggacaaaaactaaagtacttcatccctgttgaagggaggttcggctagatacaacaggaaaagttattttctctaaatatttggaatatatagactgtactttgatatttttcaagtagtgtggctcatttaactgtaagaattttgaatttttccttcttttcaagaagtctagagttaggttttaggattgatcaattcagaaattcagctgctcagattaatatatttctcttcttctatcctaccatgttgccttttattaggcttttttcctcttgccttgacctcccaaaatgttgggattacaggcatgagccattgcacctggctagtttttttttctttttttaaattcctgtttttactgttacttcttgatttctaaattgtaagcattatatattgacttcccattaatctttctgcttcccacctctccagtttttttttgaccttgtcgtgttttcttttatttttttgttacggatttataccttaaaaaaataaattattctactgtcatttcagtgggtgtctggggaagggtatgaaattgcatacgacagatggtcagttccccatctttagccagaagaccctttgagtcttgagaaagtaagaggtttatctctaaagtactgtttagaacctgtgctcccacaatatttatataattcgttataatttttatgttcttactggcaaaaacctctaatgtctcactcctgtcattcctggaacttcatatgaggcaacagaatacctctgctgtaattaccaaagacttcgcacatagttagcttttccccacagcctctcaagacagggattttcccccatcttccaagtatctgaaaaatatatttgagaattttactgtacatggaaatgatactttatagttaggcagatagttttcttttgtgctttccagaacaaaaattaaccttttctgtgtatttaacatttggagaaagttttttagatagtgcttcattgattgcccttcatcagaccttgttaaaaaagtaatgtaggcctggcttggtggcacctgcctgtaatcccagcactttgggaggctgaggtgggaggattgcttgagcccagaagttcaagaccaacctgggcagcatagtgagaccctatctttacaaaacaacttaaattaaatttaaaaggtaatatgggtgatttgtgagctatgaccatttactgttgttatctgtcacaagtgatcaggagtttaccttttctgcacactttactgtgttcagggttcttcaggtgaaaatataattttcgtagctagttctaggagtgaaatatggcaatggtaattctgtgacctttacaaagacattgaaactctaaactgctgtaattttttctcttaattttgaaaatttctttacaaaggtagttactgcttttagaacattcaaacaatacaaattataaaggagaaggcacaacaaatttgaaatcttaccaattacatttttatgaacatctttctagcacctgtatctgtcatatgtatacatactacccatgctgttttggagtttgtttttacatccatagtgtatcatggagaattgttcatgtttatgaatatagatatacatttgtcttatttgaaggcattctgttataagaatatgccataatttttatgtacagccccctattgatgagttaggtaggttgtttaccatttaactattatgaacaatgttatatacatcatgttagatttagcatatttactgggataatttttttttttttttttttttttgagacggagtcttgctgtgtcacccaggctggagtgcagtggcacgatcttggctccctgcaacctccacctcctgggttcatgccattctcctgcctcagccacccgagcagctgggaccacaggcgcccgccaccaggcccagctaattttttttttttttttgtatttttagtagaggcggggtttcaccatgttggtcaggctggtctcaaactcctgatctcaggtgacctcccacctcggcctcccaaagtgctgggattacaggcatgagccaccgcgcctggccaataatttttcattatgtgggacagtgctgcacattgtaaaacttctggcacccctggctaccacctactaattgccagtaagtgctacttagtcagtgtgactgccaaaatacctgctagagtgatgtctccaattgagaaccactgctttaggtaaattcctaggaaggagataactggatcaaaggcatgcattgaaattttggtacagctcgctaaataacccttcagaatgttgtactaatttatacttgtagtgacattggatgagagtacctatttgctcattccctcatatagcacttgaattttgtttttttatctgccagtcagttgattgatacatgatgactggcatagattgggcgtcagtttctaatcggggaaaatggctggactagatgaatttctctttgagcagcttctaccaagaaccctaatatgcatataatttttaatttatggtatatatagttgatctcatattcacatatatatgtattttatttgaattatttccttggccaacacacgtaaacaaaatgaaaaaggaataaaagtgtatacaatgaaaaataagatttccttctacctccagtcactcaatttcactccccatagacaattattgttacgagtttctcatacatctgcttaaagatattctctctctatatatattatttgttctctcttttataaaaatggtagcatgttatacaacaccgttttgccatatgtacttttactttatattagattttaaattgttctacactagtgcatgtggtgttgcttcattctttttaatgactgcatggtatttcattgcacagatatataatactacagttgaaccatcctgtattgatggacatccaattttttcccaatttttttttttttttgagacggagtctggctgcctcccaggctggagtgcagtgatgcagtctgagctcactgcatgctccgcctcgcaggttcatgccattctcctgcctcagcctcccgagtagctgggactacaggcactcgccaccacgcctggctaattttttgtattttgagtagagacggggtttcaccgtgttagccaggatggtctcgatctcctgacctcgtgatctgcccgcctctgcctcccaaagtgctgggattacaggcatcagcccctgcgcctggccttttttcccaatattttatcattttaaaccatatttagatgtgtatgtgagagaatgtatatgtatgtgtagaacaattaggtactgtaataagtaacaaatatgttaagagattaatcctagatttttttaaaaagtactttttagggctgggtgcggtggctcacacctgtaatcccagcactttgggagccccaggtgggtggatcacgaggtcaggagattgagaccatcctggctgacacagtgaaaccccatctctactaagaatacagaaaattagccgggcatggtggcgtgcacctggagtcccagctactcaggaggctgaggcaggagaatcacttaaacctgggaggcgggttacagtgagccgagatcgcgccactgcactccagcctgggcgacagagtgagactctgtctaaaaaacaaaaaaacaaaaaaaaaacaaaacttttaaaaataaaaatataatgtatgcaaatggttaaaaggatgactagggccaggtacggtggctcacgcctataatcacagcactttgggaggccgaggcgggtggatcacctgacctcaggagtttgagaccagcctggccaacatggcaaaaccctatctcaacaaaaaatacaaaaattagctagctgtggtggcatctgcctgtagtcgcagctactcgggagcctgaggcacatgaattgcttgagcccaggaggtggaggttggagtgaacccagattgcgccactgcactccagcctgggcaatagagcaagactctgtctcaaaaaaaaaaaaaaaaaaagtatgactaataaaagtaaaatctcccttttattaatctttttccattcttaaaagatagtcactattcttaggtatctttatagaaaaatactatgtatgtaagaaaacatatataaagcttctcactttaaaaacatttacgaaaatgtgatcgtattatacatacagggctgcattccaaaccttgcctttttcacataaaaatcttagctatctggtattcctttaattttttttttttttggagacagagtctcaagtcacctgtcacccaggccggagtgcagtggtacgatctcagctcactgcaacctccacctcccaggttcagggattctcctttcttcgcctcctgagtagctgggattataggcatgcaccaccgcgcccagctaatttttgtatttttagtagagatgaggtttcaccatgttggccagctggtctcaaactcctgaactcaggtgatctacctgcctcagcctcaaagggctgggattataggcatgtgccaccacgcccgacctatttccttaaaatttttaaaggttatacctatagtcaactaaaaatgtttataaaaaccaactatactgatcataaacatatagttcaatgatttatgagaaggcaaacacctaatatacctatacctcaggtcaagaaatagaacatttccaataccccaatctcccttgttgctccctccagcctctatctatcttctctccttctcagagcagtaactgttagcctcactttatgatagtcaccttgctttctttatacagtcaatccttattattttcagattccacatttgccaattcatctactcactaaaatttatttgtaaccccaaaatcaatacttatggtgttttgtggtcattctcagacatacacacagttgccagtcccctcatgagcccgttttcagctgagatagaaataaggtggtgctatgccttcttgtttcagcttttatactgtaaacaaatgccccttttgcagtctatttgttttatttatttatttatttatttttgagacagagtctcgctctgtcactcaggctggagtgcagtggcatgatcttggctcactgcagccttcgcctcccgggttcaagtgattatcttgcctcagcctacctagtagctgggattacaggcgcccaccaccacacccaactaatttttgtatttttagtagtagagacgaggtttcaccatgttggccaggttggtctcaaactcctgacatcggcctcctaaagtgctaggatgacaggcgtgagcccctgcgcccagcctttgcagtctatttaatgccacatttttctcaattttttttgttttcttggtgattaaactgttttaaatggcccccgaatgtagttctaaagtcctgtctagtgttcctaagtgcaaggctgtgatatgccttacaaagatacatgtgttagttaagctttgttcaggcatgagtgagtgcttttggccatgagttcaatgttaatgaatcagtaacatatattaaataagatgtctttcaacagaaacacataaaaccaaagtttgtgttgattagctgacaaaaatgttgtgaccctctaaaacaggagtgtccaatcttttggcttccctggaccacactggaagaagaataattgtcttgggccacacataaaatacactaacactaatgatacctgatgaacaggaaaaaaaaatctcatagtgttttaagaaagtttatgaaatttgtgttgggctgcattcaaagccatcctgggccatatgtggcccatgggccacaggttggacaaggttgctctagaggctcataagagtctaattctatttcccctataagtagtggctatttgccagttaaatgtttgcatcaactttttagaacaaaactactgcaagtaatgagaattgactgtagttttatcacctaaatatgcattcctaaatattagagtagtattctgcctgtttttaaaatgttatgtaaatggaatcacacagtgtatattcttttgtgcttggcttcttctgtttaatgtttgtgagactcattcatgtttttacatgtaacattaatttgccatttttattactatataatagttgtatcaatataccacagtttatttttcatctttttttttttttttttttttgagatggagtctcactctgttgcccaggccagatcacagtggcgcgatctcggctcttggcaacctccacctcatgggttcaagcgattctctcctgcctcagcctcctgagtagctgggattatgggcgtgtgccagtacccctggctaatttttgtatttttagtagagatggtgtttctccatgttggacaggctggtcttgaactgctgacctcaggtgatccgcccacctcggcctcccaaagtgttaggattacaggcgtgagccaccgcacccagcctcatcctcttactgatggatgtttgggttatttctactatgtggcttttgtaagcagtgttgctatcttatacatgtttttaactacacatgtacacaccatttctcttggatatacagttggcccttcatatgtgtgggtttcacctccatggattcaacctattttggatcaaaaatattgggaaaaaaatgaaaggttgcatctgtactgagcatgtacattttttgtcattattccctaaacaatacagtataacaactatttacatagcttttacattgcattagatattataagtaatctagagaggattcaaagtatataggagaatgtgtgtagattacatgctaatactacactattttatgtaaatgacttgagcattcatggattttggtattcacagagagtcctggaaccagtcccccagaaacaccaagtgatgactgtatgtggaattgctgagtgaaccccatcagttttagattcttaccagtttagaatcagtttgagattctcaccatttgtgtatgagaattcctaacttggtagcgtcataatatatctttattctaattgctaatttatttgatttgttgtaagttagatagtagaaattatttgttcttaatttcagactctgtatacatttcttattcttcctttaataatgtatatgcaatacatttaatgccttaatattccttttggaggacagacctcttatcctctttggagagcaacacagttattacagatttaaaaatctttattactttttctgtttataaaagtaatatgtttttatttagaaattcaaataataaagaaatgaacaaaacaagcagggaaagcctctctataattgggctgtgtgttaaaggatagagtaaagggtaaaggatctctgttacgtacattacctaatttttaaaagatggtaaatatagaccaggtgctgtggctcgtgcctgtaattccaacactttgggaggctaaggtgggagaattcctcgagcccaagagtttgagaccagcctgggcaacatcgggagaccccgtctataaaaataaaaaaattagccaggtgaggtggtgcatgcctgtggtctcagctccttgggaagctgaagtgggaggatcacttggacccagggagtcgaggctgcagtgagtgtgatcttcccactgcacattccagcctgggaatcagagcaagaccctgtctcaaaaagaaaaaaaaaaggtacatatctatatttggtagggctattttgatacatcagtttggtatgtcccatgagtcataatgtttggtgttaggttatgagcatttagacccttcaaggaatggtgggaatttttcccttagaacacaggacgatgtctgtgcaggcagtaatggatttatgagtctgctctaatgtacattctcaccatgctatgctccaagtgttttatggaaacatttggcaaatgcttcaggaggtttagcaatgattttgctagatagactagaatgaaagcccaaataaaaaagaatctcttctattatgttttttagaacccccagttctataaatgaggacctttgataggaaagctatagggatggctaaacttctacttttctgaaactttggatccctagtcccttgtctgtgttgctttgtctttaaaatttgctttcccctattggaatttgctggggagaaaaaaatgtttaaaaattagtaccaagtaacatttgaaatggagcagttttatgagttaggatagtattaggcatttgtttaatgtttattgaatgcatagatgagctgggaggtgcttattagtgtatagcgtttcagaagtggaaataagaagaactttatccaacataggtggggctgtgagagatgcagtgagatgaataagcagatgattcaccttttttctaaggtttgagtctatatatgtagatatcaaagccaaaggtcaatacctgtattaagaatatttcttgtcctcatcatgacttttgtaagtagagcaactctacttagaaaaaaaattatttcttcaaccaagacagatgctaacatttacctgacacagatataaaccatgggttatcctaggcaaaccagaacatatagttgctctaattaaaagggactttattttttttagctctcattggagattgtagatccaccttaacagatttctctcctgccctatgttatactttttaaataacacagaatttgcagaaatcattagtaaatttgagtgcaaacttgtatgttcttctaatatatattttagaccgcaaaccaagggccaaaatttaaagaccgtcggctacagatatcatggcacaagcccaaggtaccatctatatccactgagactgaagaagaagaagtcaaggaggaggtaaatttagtggttggaaataagagttgaattagatcacttctcaattatgtattttttatgatattaaatagtataaattaaaaaatgctgggtttttctttcatgcatgcaaattaagacccgtttagatgtttattagagaattaaaacaggtctagagatataagaagctgtgttaggggttattttcttctgatataggaaagactgttcttttttgtttacatttatattggatttatttgagctctagaaatttttattctgatgaataaagtcagagattacataaatgaattaaactttaattggttggtttcactttttgtttattcaagttccatagtaatagatttgagtttcttattttccttctgtgtacaattggttaaaatcagagtgtgcagaagttgaacatagaggagagaattggaaaactaaagacctaaataataaaagtactgaataatcagcttcttaaaatatatgagaatttattttgcttttttactc

SEQ ID NO: 1780 - DNA, 1194 bp, Homo sapiens
tgttcagggtctaaatctcatgatgttcaagaagtgcttaaaaaaaaacaggtaacagtcttgattcttcttgccttacagaagaaaagatgccttgaatttttaagtggttacattatcacttttaaatcagttcatgttggcagggcataacatcataatgcttatttagcttcttctctaatgtaaacttggaaaaaaaaggtggacatacagaaaaaatgtttcacaattgccattcagaatttttttttgatacactattattccctccaattctagtgtttattttctttttttaattcctaggtagataatgattcatataaaatataagacttttgtaattattatctatatgattcagttctgagtttcattgtcatcctgttaagttcacatagggttttccaaattaaatagatatttatatgtactatctcagtataattagagatttaacaggagggtgggaggcaaaattttcctggtgaaatccatagattttactctcttatttcttatttcttttttttttttttgagacggagttttgctcttgttgcccaggctggagtgcaatggtgtggtcttggctcactgcaacctccgcctcctgggttcaagcgattctcctgcctcagcctccagagtagctgggattacaggcatgcgccaccacccctggctaattttgtatttttagtagagatggattttctccatgttggtcaggctagtcttgaactcccaacctcaggtgatccacctgcctcggcttcccaaagtgctgggattacaggtgtgagccactatgcccggcctactctatcatttctaacctatagctgcatgtcacttttttcttttcttttcttttctttgagacaagttctcactctgtcactcacgttgagtgcagtgtcatgatcatggcccagtgcagccttgatgtcccaggctcaaatgatcctcccaccttagccttctgagtagctgagtaggcatgtgccaccatgccctggctaattttgttcatttttttgtagagacagggtctcattctgttgccgaggctggactcaagcattcctaccacctcagcctcccaaaatgctaggattacaagttgagccaccatgcctagcctcacatttttaaactttaaacttaaaaaataaggatttagctatt

SEQ ID NO: 1781 - DNA, 6798 bp, Homo sapiens
acagtctgtattttagagatctcttgattgacttttcaaacactatcactgccattcacaaaaggggatttttgattcttcttaaatagcttttctacctttttttgaaaattgaaagttgctgaaactagaagaacaaaattccactacccagaattattggtattggcttttaactttttatttagacataatttcagatttacaaaaaaagttgcaagaatagtacaaaagaaatctcagctatctttcaccagattcctcaaatgttaacattttgccaatttgctttatccttctcttcataggtttcttctgaaatgttttgctagtaagttgcagatgtgatgccccttaacccataaatacttaagtgtattttctaaaaattaggactagtcttacctaacaacagtacgacaatcaaaatcaggaaactaacactgataaaatacctaatctacagttcttaaatagattttgccgatttttctgagttggtgtacttttttttttttttcctttttggagatggagtctcgctctgtcacccaggctggagtgtagtggcgcgatctcacctcactgtaacctccgcctcccgggttcaagcaattctcttgcctcatcctccatagaagctggaattataggtgcctgccaccatgcctggctaatttttgtatttttagtagagacggggtttgaccatgttgtccaggctggtcttggaacttctgacctcaggtgatccacccgccttggcctcccaaagtgttgggattgcgtgagccaccgcacttggccaatatgccttttttaaaatggcagctatatgaactatattgacatagaaaattcacctgtaagtgcacaattcaatgatttttggtaaatatacaaagttatgcatccattaccccaaaaggattccttctgtctgtttgcaagtcaccctgttccaccccagtttcaggcaagccctcatttttctgtatagatagtagtagatagcgctgcttttttgttttatttggtttttgagatggggtctctttcacccaggtggagggcagtgctgcgatcttggctcactgcaacttccgcatttcaggcttaagcaatcctcccaccccagcctcccaagtagctgggaccacaggtgcacgccaccatgcctggctatttttttgtatttttggtagagatggggtttcaccatgttgcccaggcgggtctggaactcaggctcaaaggatccacctgcctcgtcctcccaaagtgctgggattacaggtatgagccactgtgcccagccttgtttttgtttttaaaaagatgaattcttcctgtgttgctcaggctggagtgcagtggctattcacaggcgtaatcccactattgatcagtttgggagttttgcccttctctgttggcaacctggtggttctctctcatcccaggaggtcaccatattaatgctgaatggacttagcatgaacacctgatcagtagcgtgctgcagcccagaactccagggctcaagtgatcctcctgcgtagctgtgactataggcaggcacaggagtgttgctctttaatcattgaaaatggtaaaacaacaaaagtggcaatgtcagaaaaagatcaactcttttttggagatttccaaacaattgagtattttcatacttctgaaaagctttgctgtaaaagtagtttttctgttaagcatttcccattcttctttgggcataaaacacttttttttttctaggaataattcctgcagacctgacacataattggaagtagatattgaatgaatgagtgagttgtatgtgaatatttgctcagaggaatctcagttcattatcatttcagaaatttggcacgtagtgtactgatggagctagtctaaaataatctatcctgggagaaataattttgtttctatctggataagtctacaatagaggaatgcttattagcagtgttttgctgtattttgcatacttgcagtattcttaagagtgcagaaaaaaatagtttgaaagattcaaagagaaaaaagtgaaaaaagaaaagctgagtgcatgcatatgttgagtactagagatatgtcttcagggtttctttttggaccagatttcttgagataaaatttgcatacaataaaatgcatctgttttaatttcaatgagtttagacaaatgcatatacttgtgtgaccaccgctacactagaggtagggaacccttctatcataggtttctgttattttatttaatttttggggggcctcactctgtcgcccaggcttgagtgcagtggtgtgagctcggctcattgcaacctccacctcccgggctcaagcgattctcccatctcagcctcctgagtatctgggaccacaggtgcatgctaccacacctggctaattttttgtatttttggtagagatggggtttcaccatgtcgcccaggctggtcttgaactcctgagctcaagtgatctgcatgccttggcctcccaaaacgccgggattacaggtatgagccactgcacctggcccaggttcctgtttttattatcgtgggctatagagtttcttttttttgagatggagtctggctctgtcgcccaggctggagtgcagtggcacaatctctgctcactgcaagctccgcctcccgggttcacgccattctcctgcctcagcctcccgagtagctgggactacaggcgcctgccactatgcccggctaaatttttgtatttttagtagagacgagatttcactgtgttagccaggatggtctcgatctcctgacttcgtgatccacccacctcggcctcccaaagtgctgggattacaggcttgagccaccgcgcccggcccggagtttcatacttagcaggaaaaggtgctttgaaccttctaaaatgtgaggtactttcaatattttaaaaaatgctatggaaatgatttcagtgccataagataactctgcatttctctcttttaaatcccacatattatacaatccctcagcaaatcctattggctgccttcaaaatatatccaggatccaacaacttgatagcactttcaccactaccacctgttccaggccaccatctctccaggctaccatctcttatatggattattgtaccagtctcttgcttgtatcctgttcccttccaggcttaacacagtggccagtgatactgttaaaatgtgacaagtcagaaactcttcaaatgattttcacctcattcagagttaaaactaaaatgtttatttacattgtgttacatagccctacactctactcataatactcagtatttatttctgattttcttcatttattctgctccagtcatactgttggccttgctattcctccctcaaatacaccattcctgcttcagcctctttgtatttgtcttttcctttgcttggaagtctctttcccccagatatgaatagggcttcctgcctctgcctcttttaaatctttgttctaatcttcaccttcttggtgaggcctaatcgctgtatttaaaataaactactccatagctctcttccctaatttatttttctacaaagtacataccatctttcaatgtattataatttattttgtttatcatctataggtaacagataagctttgcttatgattatgaaagttaattctcaatcagtttcacatggcaaaacacataaacctgtgttgaaataagtagttggtaatcttttaggctgcttaaagtggacattagtatttatcaaagatgagaaatgttttctgattttccatgagagaccaatcttttttatttttgttttgaaatggagtctcgctctgtcacccaggttggagtgcagtggcgcggtcccagctcactgcaacctctgcctcccaggtttaagcaattctcctgcctcagtctcccgagtagctgggactacgggcgcctaccaccattcctggctaatttttgtatttttaatagagacgggctttcaccatgttggccagtctggcctcgaactcctgaccttgtgatccgcccgcctcagcctcccaaagtgctgggattacagatgtgagccaccgcgcccaggagaggccagttatcttaaaggaatatccataaaaattagctgttaactggtatttttgccttcacctttgaagtccagcctatcaacaagcaagttttggcagctccaaataaaggggaatatgttatggaaaaatttgaagtgaatggaatgggtatattggcataaacgaaaattaaatatatctggttaactctgcagaatgaattacacatttaaaaaccataaaatataacttaaataccaagaatatagagttttactttttttttttttttagacggagtcttactctgtcgttcaggttggagtgcagtggcgcgacctcggctcactgcaacatctgcctcccaggttcaagcaattctcctgcctcaccttccagagtagctgggattacaggtgcgcaccaccacacctggctaattttgtttgtttgtttgtttgttttcttttgagacagagtctcactgtgtcacccaggctagagtgcagtggcgcgatctcggctcactgcaacctcggcctcccgagttcaagtgatctcctgcctttgcctcttgagtagctgggattacaggcacccgccaccacacccagctagtttttgtattttagtagagacggggtttcaccatgttggccgggctggtctccaactcctgacctcaagtgatcggtctgcctcggcctcccaaagtgctgggattacaggggtgagccactgtgcccagctaattttttttttttttgaaactgagtcttgctctgtcgccaaggtggagtgcagtggcgcagtcttggctcactgcaacccctgccacccaggttcaagcaattcccctgcctcagcctcctgagtagctgggactacaggcgcacactaccatgcctggataactttttgtattagatacggggtttcgccgtgttggccaggatggtcttgatctcctgaccttgtgatctgcctgccttggcctcccaaagtgctgggattacaggcatgagccacctcacccagcccagtgtttatatttttagtggagacaggggtttcaccattttggccaggctggtctcgaactcctgacctccagtgatctgcccgccttggcctcccaaagtgctgggattacaggtgtgagccaccgcccctgaccgagagttttagtttttaagcattatttatatctaatattattgggggaaaagtggttttaaaaatgagttcatggcccagtcttgtaaccattgtgaggctaggcactgggccattgctagaatatagtatgcggcatgagatagcataataaatttgtttattgaagtcctcagagtttgtttactgatttattcattaatcagtttattcaacaggtatgaaaaccaactatcctaagaaagcactgagataggctattataatgataatagaagagcttctgtaagtaggacagtagccctttctgttttaaaaagagataccacccccagtttttggttttggtcaaaaagttttacagaaagtttattttaaaactcaacacatttacagtcttgcaatcttgtgtttttcattgttaatatgtactgataacctacctactgtttaaaacatttctaatacctcatttgccaagtatattaaatcctcctaagggctgggcgcagtggcttatacctgtaatcccagcactttgggaggccgaggccgacggatcacttgaggccaggagtttgagaccagcctggccatacatggtgaaaccccgtctctactaaaaatacaaaaattagctgagcttggtcgtgcgtgccttgtggtgtgcacctgtaatcctagctacttgggaggctgaggcaggagaatcgcttgaacccgacaggcggaggtttcagtgagctgagatggtgcctctgcactcctgggtgacagagcaagactccatctcaaaaaaaaaaaaaaaaaaatgcatcctagggattcctttacctataaagttttctaaatattttaagtatactgtgttttctgaaattgaagtttagttttattgaatatggtattatcccaatttaagtcaaaggaattctgaggaagtagagctgtgagcatgtaggtcatgcttttctgttttaaagaaatgtctagtaaacaggtaaacgcatactcaacctcattagtcatgagggaaatgtaaattgaaataagagtatattttacttatgaaattgtgagaattttgacactgatctattctaccaatgatgaggatatgaggaaagggcatacccatattctggtggtgggaatatacatttatatgctagttttcagggatgattttggaggtaaagtttggatacatataattttttttttttttttttttgatgtggattcttgctctgtcgcccaggctgacgtgcaatggcaccgtctcggctcactgcaacctccgcctcccaggttcaagcgattctcctgcctcagcctcctgagtagctgggactacaggcacctgccatcacacccagctaatcagatacatatagttctaacctgtattagagaattacctgtacagatgcatacagttatatgtctattatctccaggaatgttcaacattatttgtgagagctgaaag

SEQ ID NO: 1782 - DNA, 1149 bp, Homo sapiens
aaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaac

SEQ ID NO: 1783 - DNA, 3960 bp, Homo sapiens
ctcctacatcactttaatttataaatatgttgagaacattttaatttgtgtgagtcaataatgtcttcccactgtaaaaaatgaaagaaacaaaggaaatgctgaagctaatgtgaatcacaacagaaccagcctcaatggaatgaatgttagagcagcctaagttcactgggagcttaaaggcttgaggcaggaggtttaggaggaagagagatatggagaagaaggtgaggatctgtcaagtttacttacaatatttttaatatctggccacgtactcagtgaattatattaaagcactttggaaaatgcatacgtactttatctttttaaaaaagcaaaagacaaaaaacaaaactctcaatctgattcttacatcatctacattttgagtgcatatctcaactactaaataataattttgtcagtacactttatcatctactaaatttagaaccataaatcattctgaatgtttctttacacctttaatattcaggttcttcttgggaactaaagggacactgtggctcatcagaatggacaaggaattggagtttatctggtttgcactacttttttggcaaatatttatgagtctctaaagattggattattgacttcaagaactgacttcaaaatcaagatggactccagttcactgatctcttaagacggcattattattattgctaataaatcagttccaacaaacttccttgctaacacttcttttactgatctggagtggaaatttatatgaatattcctctttgagaagagggtggaggttgagaccgttttgattgcaagttatcttgacctggggaaggagtgtcattgaaattgctttcttggtatttgctataatcttgtatgtcaacttaaggttctttctgtggatgcaaccaaaagctattctcaagaggaattaattagcaggctatctgggattcgtggaatccatgctggataactgaatttggaaatgaacagacaggtgggtagttctggagtctgggaagaaagaaaccttgatattaacatgagcagtctgctcatgatcttaccgcttggataaaatggacacccacatgatttcattgttttctgctaattattctgctaagaatcactgtttctatccctttgttagagattcaaattctagagaaaattctgaaaatatcagtaatttactcatctgtttagttaaagggagaggcagggggtcaatctttttattatagttccaatgaactataactagttggaataaaaaacacctcaaaagtgaattggattccagttgttatatagactccggaaaatcaaaagacaaaaacacctttcatgaggaaagggaagctacagcaaagctgggaatatggaaagacgaagcaagcctttctttttgttttgctgagaggggcagttattacttattatgaatattaaaaacagaacctacaataaaaatagactgtaagagctttagtaccgagtgaaaaatgtaaaattatttgagtcatgaacttgtcccaagataaatgtggaatcaatgctaaaacctgtatagtactttaaagtaaatgtaagataagacaaagatgattgttattaccattatcaatactgatttagaaattctaactaatgaagtacagtaaggaatataaatcagaatcataattattggaaagaagataaaacttagccttgtttgaggataacatgatttgtataatgaaaacccaaacgagtcaactgaaaagctaatataaactttattatataaccagcagtaatgattacaaagaaaacataatggttttagaaaaaaattcagaataggcaaaacatacatagagaaaagcacaaaacacttcagagtaatcttaagaagaattatgggagcaaatgaagaacagcacataaaattactgtaaagtatagaaaactcactaaatgcttgtttcctttttaaaatttgacagactggactcacaggtgaaaaaagtcaaactggtctcacaggtgaaaaaaactcttttgaaactgagagtgattagggacactacttatttagtcttgtgtgtactaaattaaaaacataaaacataatgtttttaaaagtactagagcaaaaattgatacagatcattgaaacaaaatatatactccagaaacagactataatttctggaaggatttcacatatcctccggagatcctcagatttgtaaacagaaatttatacgcagcagtgtgcatttagttacgtttaaaatcatttgccttaccctaacttattcatgagcagaaggtaaatccaaatccccagtgatactcaatctgaaacagaccatgtgaagtttgtattcatcagctcaattgctgatgaatgcttgtaatttagaatgtttgcccacttcctttagagaatcttatttgaaaccattatttgttcctcttttgtatttttatatatgccatctaaatagccatggtacatctagtctgattatacttcttgttggccctcatgtttagctactttgatggatgactgcttctccttctgtgtattgtggagcccagcaaagtgaatttgtttaataccaggtagcctgtgttttgaaccctatcatgccagatatgaccttaagacatggtaaaatccttctagacattttcatgacttcagtggcaggtaaaaagcaggaatttcatttaatttatattatttttagaaaagttagaaacaactggaattaacaatagggaatggttaaaaatatatttgtacatctgtgcagtcacgttatacagccacaaaaagggattactcatagctcaaacctcagcatcatgcattatatttagttaatatgtgcacatatgccccgactccaaaataaaagttgaaaaagagaaatattaatataaaataaagaattttagatgatataatccttaccaggaagtatactatgaataacatttttttaatttcatttggtttgtatatattttatttttatattttcctttatttttcaaatttcttagaagcatgagaatcagaaaaacataatttaaaaatgtgaagatcaagatatttaaggattggaatatatattaacaatacaaataaattatgtgtcaacaattatttagcggtaacatttaatgtgtgtacttttagttgattttactaaaagacttatacacatatgtgaccaggacatgtatacgtatatgacaaaatcattctgatttgcatcctcaaattcagccctatagtttccaccactgaacagctgactaaggtaccacagtaaactcatggcagttcttctaagggcaggaaaagttatataaaatgtaggcctttaaatactggatttgcaaagttccattatgtgtggtaagaatggaaaagcgtatacctactatgtcccaaataggaaattacctataagcatcataatttaactcaccatacatactttgactcaagtaactgatttaaaaaaaaatccatgtggttggtgcatgtggttcgttatgttgtgttcataaatatgatcatcaaccgatttgcaaaacagtaaaatataataattctatgaactcaattccaaaaataatttacacctggatgaatctttttggaaaattttaccaaacagcatcatcttcagtgcttttctaaaccaaggatagaaaaatgcataaaccattggattaaatgtagagttcaagtagccaaaccaaatcaatacatcattcaaagtaggtggaataatgtagtgaagaaaagggtccatgactgtacagataaagaaagggcaccagcatattaggaaaactcccatcacaatccccaatgtcttcacagctttcctttctttgctttgtgaaattccatttttcatttccaatccaatttggagc

SEQ ID NO: 1784 - DNA, 19433 bp, Homo sapiens
caaagaaccgttgatatttgttaacacgaatgttatttagatatgttatagtataatgtgaataaaatttttgtaaattatgctaacaatcctaccaatttaacaaatatttataaagggttttttatttttgttttttgttttgttttgagatgaagtcttgctctgtcacccaggctggagtgcaatggcgccatcttggctcactgcaacctccacctcccaggttcaagtgattctcctgcctcagcctcctgagtagctgggattacaggtgccccccaccgcacttggctaatttttgtatttttagtagagatggggtttcaccatgttggtcaggctggtctcaaactcctgacctcgtgaacaatccaccttggtctcctaatgtgctgggattacaggggtgagctcccacgtccggcctcatttttgtttttgtttccttcaacttttattttaagttctggagtacatgtgcaggatgtgcagttttgttacattggtaaatgtgtgccatggtggtttgctgcacagatcaacccatcaccttggtattaagcccagcatccattatctgttcttcctgatgctctccctccccccatcaggccctccccgcaacaggcctcagtgtgttttcttccctgccatgtgtccatgtgatctcatcattcagcgcccacttataagtgagaacatgtgttgttttgttttctgttcctctattagtttgctgaagataacagcttccagctccatctgtgtccctacaaaggacatgatctccttcccttttatggctgcatagtattccatggtgtatgtgtaccacattgtctttatccagtttatcattcataggcatttgggttgattccatgtctttgctattgtgaatagtgttgcaataaacatacaggtgcatgtatatttataacagaatgatttatattcctttgggtatatatccagtaatgggattgctgcgtcaaatgctattcctgcctttagatctttgaggaattgccatactgtcttccacaagggttgaactaatttacattcccatcgacagtgtaaaagctttcctttttctctgcaaccttgccagtatctgttgtttctggacttcttaataattgccattctgactggcatgagatgatatctcattgtggttttgatttgcctttctctaaagatcagtgatgttaagctttttttttccatatgtttgttggccacatgaatgccttcttttgagaagtgtgtgtttatgttctttgcctactttttaatggggttgttttttttcttgtaaatttgtttaagttccttatagattctggatattaggcctttgtcagacagacagattgcaaaaattttctcccattctgtatgctgtctgttcactccgatgatagtttcttttgctatgcagaagctcttaggttcaattagatcccatttatcaatttttgctttggttgcaattgcttttggtgtttttgtcatgaaatccttacccgtgcctatgttctaaacggtattgcctcagcaatactcagcctcagcccagttctgtgcccttgctggagaggtgttgcgttcatttggaggagaagagacactctggctgttgtgtggtctccctgatgtcctggaatgtcctagccaattgagtgatggtttttctctccagtgcatcctccctgaccagccagctcttccttccccagctcttgccctgcagtgactctgaaagcttgttgttccatttactgcttgcactcactttatttcacagagtaaaaggtgctttgcaaacataagtttatgttgtttgtcttcagctccccctgtattctctcaccatgtcattggcgtggagaagcaggaacctaaacatgggaagtgaacatcaaaatatgtcatgatcacagtgtgcttcaaggtaaataccacttcagcacgatatccatttgtataaagcttaaaaataactgtcacaaagtaatatattttcagatatatctatatttacatctacatctcccctgtctatacatagatacatatctagactataaagaaaagcacagggattatgaacataaccttcagaagagtggtcacctctgttgcgaagcaaggggactggatcagagaagaaattccagcagtcctgtagcttccacaggactagaaatgtttcatactgcatgaggtcatgggtttatggatgttatttaattgttatgcttcataacttagatgcacatcccatgttgagaatacaacatgttacatttatatagtgggaaactctacagcaatgagtttgaacgaactacaactatatgcatcaaagtagctgcatctcataagcataatattgagggaaagaaggtagagaagagtatactgaataattcaactcctaaatgaattatcctattagaaatcagaagtaagtcaggcagtggttagcctcaggagggcggtaactagaaggaggcttctaagtactggtaatgttttgctctttggtctgagtactggttatgagtactgagtacatactgtactgtgtatttacactgtgaatgctcattgaacttcatacttgtgatttgtgcacttttgggtatgtttgttatacctcaaccaaaattttacatctcaaagaagtcaacgctggcctttgtcacctacctctgcacaccataaaaagtgtgattaaggctgggcacagtggctcacgcctgtaatcccagcactttgagaggctgaggcaggcagatcacaaggtcaggagttcgaggccagcctgaccaccacggtgaaaccccatctctactaaaaatacaaaaattaactgggtgtggtggtgcgtgcctgtaatcccagctactcaggaggctgagtcagaaaaattgcttgaactcgggaggcggaggttgcagtgagctgagatcgcaccactgcattccagcctgggtgacagagcgagactctgtctcaaagaaaaaaaaaaaaaagtgtgattaaatagactgatgaatgaaacagaactgaatgtctatgaatagatcctaatacatgtggcactttacacaatgataaaggtggcttttcaaattagtgataaatagaaaattcaacaaatggtgttgggataaatgagtagccatttggaataataaaaattagtttagctctactttatatcttacaccaaggtatatttcagatgaataaaagattctttttatttttttaagagacagagtcttacgctgtcatccaggctgctggagtccagagactcactacagccttgagctcctggactcaagtgatcctctctcctcagtctgctgagtagctgggactacaggtgtgcatcaccatacctggctgcttggctaattgttagttttgttttttttttctagaaactgggtctcactatgttgcgtaggctggtctcaaactcctggaatcaggtgatcctccaatctcagcctctcaaagcattaggattacaggtgtgagccactgtgccaggcccaaaagatttaaattttaaaataaaacaataaaatgagtcaaagaaacattgagaataatttttataactttacagttctttttaaaaagcacaatatagcaaaagacctcctaaaactagaagactgatgaattaaattgtttaaaaatgtgtggcaaaatccacaataaataaaaagttagataacaaattgggaaaaatatttccaattcataatgcatatagacagctaacatcaccagtgtaaaagagctctttcagatcaataaggaaaagatgaataagccaccagaaacatggacaaaaagtatacacaaacagttcattgaaaagaaataaaagtgactcaaggccaggtgcggtggctcgtgcctgtaatcccagcactttgggagaccgaggagttcgagagcagcctgaccaacatggcaaaaccccgtctctactaaaaatacaacagttagctgggtgcggtggcacaggtccgtagtcccagctacttgggaggctgaggcaggagaatggcttgaacccgggaggcagaggttgcagtgagccaagatcacctccggcactccagcctgggtgatagagcaagattctgtctcaaaaaaaaaaaaaaaaaaaaagtgactcaaacgtgaaaagatgctcaacctcactcatgatgaataaaataaaaatgaaagctacaaatatattattcctgtagtgctggagtacaccaggtattatagaagtattttaaaatacacttagttggcaagagtatggggaagcaggtactttcttacgttgcaggtgaataaaagttggtgaaatctttaagggcaatagtttactgaaaggcaagatctattaatattacagatgaatataccatctgaacatatcatttaatccaataattttactttgggaatatatcttacaaatatgttagaacataagtaaaattacacacacacacacacacacgttattaatcttattttgagtagcaaaaaattggaccaaaaaatactaatatctatcaatagaaaattggtaaataaaatgcagccatccaaaagaataaaaaacaattattttacaaatatggaagaacttcaagtgacaaaagcaatgtgtaggagttgtataatattatatagtatctatcatttatattttttaaaaggtaaaaaatatactttatagacttagaaataaaattaacaatagaagtataaatcgaactcataaaatataagtgaatagtaaagggttgactcagcagctatgggattgcatgcctcaaagaaaagactgactcttgaccaactattagctcttgaaatatcctgcctgataagagtgtctttgtatacctcgggccttgggcaatgccagagtttgtgctaataatgtaatttatggtgaacacctgtttttgcttgcctggagccctgggtcatattgtatgagtttgacttcatagggaggaatgggttggagactgagtattaagggtcaatagtcgggggtcttcatgcctatgcagctgaccttggacacaaaagtttgtgtgagcatccctggttgacaattctttgtccatattgtcacacgtcattgctgggagaattaagttctgttcatataactccacagggagaggacaactggaagctgctcctggttctgcctggactctgccctaagtgccttttccttccgaatgtattctatagcctttcatcgtaataaaccataaccgtgaatagaacagcttgtctaagttctgtgagtccttctagctccttattgaatacggtggcagcattgggtccctcaacacactagataaagtaattagagaagcatttatttttttcagatgctggcattgaaaaggaataaggactacttattgagttaagtattcagtttaagatgttagataaagggcaacaaaataaagaaagtagaaggggctgtctactgtttaccatcacactttgctgcctctcttggacaatctatagacaaagttaataaaagagtgcaacaagttttccgaatgcagaattgatatacaaaaaaagattgcatttctatataccagcaacaacaactcagaaaacataattttaaatgcaacactactaaaaataacaacataatcattatggaatcatgaagatgtcaattctcccaaaattaatccataaacttgatgcaattccaatacaaactcaagaggatttttttacaatactgaacaagctaatgtcacaattcatgaggaagagcctatgtttaaaaacaaagcaccaaagtgggagacttgttctaccagatttaaataattattaaaaagttaagttaaacagtgtagtattggtgcagagatagatgtataagctaatgaaatgaaagagggcctagaaagagcccaaatcatatatggaaatataaatgacagacatggcatcagaactcagtggtaaaagatgagagtattcatctcccatctttttcaaaagatgttgaaattcaaagggtgttgaaatttttggctgttgatattataataaaaataacatttggtccttgtccttagttcctgacacacagctcctgaagtccttggaatctccagagtgatgactgagttaatcaccaatggtgaatggcaatgattatctgtgaggaccaaagctgagtcttcgtgcttagggcaggagcgcagacaaggagaggggctcttccttctgaggcttgtcatctagaactcattgtcactggaagccagagcctaaatgggcctatcagttgccttgggttataagaacaagtttgagtatttattcatttatttatcttgagttcggggcccctgtgtatctgctcactgcctgcccgcagttcagcttgtgcttggctcactcaccattcagcgaaatgaaggaaccagcggaatgaaggaaccagcggagggacctccgggaggaggcgctgcccagcgagcctggcgccggggggcggggcctgacgggagctctgctcaggcttcaacatggcgggccgtttcggttgacttcgcctgtggaaaccgaattccccctccatggtttccccaggatatgagttgggggcctcacctcgcctataagggtcaggcgagctttctggatgctcgagggacctttcggcctgcgcagccggagcagcttgtcccaatgccctgccatttctgtgagggcccacgaggcctggaggagcctcggagcccccgcaggccctcgcgtcactgcctcaagagggtgctcggagccctgctcgggagctggtccccaacgaggtgtggaaccccttcttgctggaactccacggagagactggtaataagatagtaataagaccgactactgtttattgaacctccgctagtcactggctgtcacgggttgggcgagaggtggaatataaggcccagagttcctctattatagccatggagagccattaatacctgcttaatagagttgtggtgagacatggaatgggcaagaaaggcactcgatttatttgatttttagaatcatgattattattattattttgagacggagtcttgatctgtcgcccaggctggagtgcagtggtgcgatctcggctcactacaagctctgcctcccgggttcaagcgattctcctgcgtcaccctcccgggtagctgggatgacaggcgcgcgccaccatgcctggctaatttttgcatttttggtagagacgggttttcatcatgttggccaggctggtctcgaactcctgatctccactaatccacccgccttggcctcccaaagtgttgggattataggtgtgagccacctcaccagaaagtgccaagaaaggcactttagacagtgccagagttgaggatttggcctctgactcgctgcagttgccacactgcagttgccacactgtggccttagaacagtcttatccagtcctgaaaaccccagtgccttggaaacatcaggattggtcagaaggacagtaagtccttaaggcgccagcccctgctcctccccccagattgaggggtaagtattccaagctctatgcaggaccctaatcctggatgtggacacccacagtcctgctaggacctgcttccagaagagttgatcccagccgtgaaagtgcatgatgccttcagcgaagcaggcaggaaaggctcaagtgatcctcctgtatcaccctggtgagtagccagtagctgggaccacaggcgcgcaccaccacgcctgcctaatttctttgtagagacggccttcgtcatgttgcccaggctgctctggaagtcctgagctcaagcgatgcgcctgccttggtcttccaaagtgctgggattacaggcgtgagccaccacgctcagcccaatttgtgatctttcatgcactctttcatgtagcatgttttcaaggttcatccaacttgcagtgtcttaatgctgaataatatttcattgtgtagatataatgtatttttcaagttttgtttatttttaattggtacacaacaaatatttgtacatatttgtgtggtacatatgtacatgtgatatgttgttacatgcatagaatatgtaaggatcaatcagggtatttaaggtatctgtcactttgagtatttgtcattgccatatgttgggaacatttcaagtcttctcttacagctattttgaaatatacaatacattgttgttcactgtagtcaccctactctgctatagaacattagaacttaactccttctatctaactgtattaaccaaccactcttccctgccaacccacacacccttcctagcctctggtatctatctgtccaccgtcaacttttttagctcctacgtatgtgataacatgcaatatttgtctctctgtgcctggcttacttcacgtaacaatgacttccagttccatccaggttgctgcaaacgacatgatttcattctttttttatggctgaatagtacttgattatatatatcgcattttctttatccatttgtctgttgatggacacttaggcagattctatatttttgcttgtgaatagtgctgcggtaaacatggaagtacaggtatcatccctttgatatactggtttttttcctttagataaacagccagtagtggcattgctggattgtatggtagctctattttcagtttcctgagaaatctccatactgttttccatagtgactgtactcatttacattcccacacataagagttcccctttctctgcatcctcgcccacatccattattattttgtctttttaatcatagccgttctcattgggtgaagatgatatctcattgtggttttaattttcatttcccttattattagtgacgtcgagcattttttcatatacctgtgtgtcttctttggagaaatatctatttatgtcctttgcccacattcgttcattcatttattggagtcagggttttgctctgttgtccaggatggagtgcagtggtgcaatcacgagtcactgcagcctccacttcctggtctcagatgattctcctgcttcagcctccagagtagctgagaccacaggcacgtcccactgtgcccagctaatttgtatgtgtgtgtgtgctttttgtttttgtttttgtatttgttttttttttggagacaggatgggagtgcagtggtgctatcactgctcattctagcctcaatctcctgggctcaagtgatcctcccacctcgttttttgatttttgtagagatgaggtctcactatgttgcccaggctgggcttgaactcttgggctcaagcaatcttactgcctcggcctccccaggtgctgggattacaggcatgagccaccaaacccagcctaatttttgtatgtttttgtagagacggggttttactatgttacccaaggtggtctcaaactcctgggctcaggcagtccacctgcatcagcctcccaaagtgttaggattacaggcatgagccatcatgcctgacccttttcccacttttaaatggaatgattattattttttactgttgaggtgtttgagtttctcgtgtattctagatattaattccttgttggatgaatagtttgcaaatattttctcccattcaacaggttgtctcttcactctgctgtttcctctgatgtgcagaagctttttagtttaatatagtccaatttgtctacttttgtttttgttgccgtgcttttgaagtctcagccataaaatcttttcctagtgtcctgaagtggttcccctaagttttcttctggtagttttatggttttggggcttatgcttaagtctttaatccatcttgagttgatttttgtgtatcgcgaaaggtaggaggttagttgtgttcttttgcatacatatggatatccaattttcctagtaccatttattgaagaggatgtcctttccccaatgagtgtccttgacacctttgttgaaaatcagttggctgtaaatgtatggatctatttctgagttttctattctgtttcattttatacctgtttttataccaatactatgccgttttggtcactagagccttgtaatatatgttgaagtcagatagtataatgtctccagctttctttttacttaggattgcttctctattcgagctcttttttggttccatatgaattttaggattattttttctacttctgtgaagaatgacactggtatgttgatagggattttattgcatctgtgtattgctgtgggttgtatggtcattttaacaatattgatttttttctgatccatgagcatgagttgtcgttccatttctttatgtccttctcaattgctttcatcaatgttctgtagttgtccttgtagaggtttttcacctacttcgttaaatttttttcctaggtattttattttcttgagctatgataaatgggatttccttcttgatttctttctcagctagtttattattggtgtgtagaaatgatactaatttttgtatgttgactttgtatcctccaactttttttttttttgaatggagtcttgctctgtagtccaggctggagtgcagtggtgccatcttggcccactgcagtgtccgcctcctgggttaaagccattctcctgtctcagtctcctgagtagctggaactacgggcgcacgcaaccaggcctggctaatttttgtgtttttagtagggatggggtttcaccgtattggtcaggctggtcttgaactcctgacctcgggtgattctcctgcctcggtctctgaaagtgctgggattacaggcatgagccaccgcacctggctgtatcctataactttactgaacttacttatcagatctaagagtttttggtggagtctttaggtttttctagatacaagatcatgtcatctacaaagagggacagttttacttcctcttttccaatttggatgtcttttatttgtttctattgtctgattgctctggctaagacttccagtactgtgttgaataggagtggcaaaaatagacatccttgtcttgttccagttcctagaggaaaagctgaaagccacgataggatggtgttaactgtgggtttgtcatatgtagcctttattatgtcgaggtattaataggctccttcaatgcctagtttgttgagagtttttatcatgaagatcttttgaattttatcaaaccctttttctacatctcttgaaatgatcatatggttttgttcttcattctgttgatgtggtgtgttatctttgttgattgatgtatgttgaactacatttgcatttctgggacaaatcccacctgatcctggtatgttatcttgttgatatgctgttggattcagttggttagtattttgttgaggatttttacatctatgtttatcagggatattagagtgtaactgtttttttttgttgcattcttatctggttttggtatcagggtactgctagcctagtagaatgaggaagaattccctccttttcaattttttggactagtttgaggagaactggtgttagtttgtctttgtaagtttggtagaatttggtagtgaagtcattagcagtgaagccattgggtcctgggcttttcactgtttggattcttttttattatggattcaatttcattactcatgattggtctcttcaggttttctatttattcctgattcaatcatggtaggttatatgtgtcaaggaatttatgcatttcctctaagttttctagtttattaatatatagttgttcataatactgtctgatgacttttggtatttctgtggtgtcagttgtaatgtctacttttattcgtttatttatttctttattttttgacacacggtctcactctgtcacccaggctggagtgcagtggtgtgatcatgactcactgcagcctcaagctcctgggccgacgagatcttcccaccccagacttctgagtagctgggactacaaacatatgccaccatgcccagctaatttttgtattttttttttagagacagagtttcgccatgttgcccaggtttgtctcatactcctgagctcaagcaatccacctgcctcagcctctcagaaatgctgggattacaggcattagccactgtgtctggtaatgtcttatttttcatcttggattttgtttatttggatcatctttttcattttcttgtttagtctaactagccgtttattgattttgcttacctttttgaaaaaggaactttttgtttcattgattctttatattgtttttgaaatctatttcatttagttctgctctgatctttattatgtctgtccttctactaatttgaggtttgctttgttcttgcttttctagttctttgaagttatcattagtttgtttatttgaaatctttctacttttaaaatataggtgtttattgctataaacttccctcctagcactgcttttgttgtatcccataggttttgttatgttgttttcaattttcacttgtttcaagacatttcattttttgagacagggtctctctctctatcactcaggctggaatgcagtggcgtgatcttggctcactggaacttccacctcctgggctcaagcaatccttctgcctgagccttctgagtagctgagattacaggcacacactagcatacctggctaacttttgtatttttttgtagagacagaatctcactatgttgcccaggccagtctcaaactcctgggctcaagcaatccacccaccttggcctcccaaagtactaggattacaggcatgagccaccacacccagcctgtttcaagacattttttgatttcctctttaatgtcttccttgagctaaaggtcattcaggagcatgttgtttaatttccacgtatttgtacagattccaaagtttctttgttattgatttcctatcctatgtcactgtggtctgagaagatactggtatgattttgatttttgaaaatttgttgagacttattctatgtcctaacatatggtctatcttggagaatgtttcatgtgctggtgaagaggtatgtgtattctgtaactgttgaatgaaatgttctataaatgtctgttagatccatttgttctaaagcacagtttaaaatcagtgtttctttgttaatttcctgtttagatgatctgtctaatgctgagtagagtgttgaagtcctcatctattattgcagtctatctctccctttagatctaatgacatttgctttatatatctgggtatcccagtattgagtgcatatatgtttagaactgttacatcctcttgctaatgtatctccatgtcattctgtagtgaccatctttgtctctttttactgttttgtttgtttgtttgtttttgagatggagtcttgctgtgttgcccacgctggagtgcagtggtgtggtctcggctcactgcaacctccgcctcctgggttcaagcgattttcctgcctcagcctcctgagtagctgggattacaggtgcctgccaccatgcccagctaattttttgtatttttggtagagatggggtttcaccatgttgaccaggctggtctcgaactcctggccttgtgatctacccgcctcagcctcccaaagtgttgggattacaggcgtgagccactgtgcctggcctctttttactgtttttgacttaaagtctgttttatctgatataagtatagctgctcctgatcacttttggtttccctttgcacagaatatctttttccagtcctttcctttcagtctgtgtgtctccacaggtgaggtgagtttcttgcagttggcatatatttgggtcatgtttattttttaaatccgttcagccagtctgtgtcttttcagtggaaagtttaatctatttacattgaagactatttttgatatgtgagggttattcctgtcattttattaattgatttctggttgctttatatgtcctttgtccctttctttctctcttattgttgatcattgtggattggtggttttctttagtgataacttttgaattgttcttcttatttatgtgcttgctctaccagtgggttttatactttcatgtgtttctgtgatggtagatatcatccttttgcttccagctgtaggactgccttacatgtttcttatatacctggttgagtggtgatggaaaaccaacggctaccattaaacttagtggtgaaagtcttaaagcttttctcctaagatgaggaacaagccaaggatgcctgctcttgctttttctattcaacattgtactggaggttctagccaggataattagacaaaaaaaccaaaacaaaaccaacaacaaaaaagaaaaagcatctagattggaatggaaaaagtgaaactgtattttttgcagataaataatgttgtatatagaaaatctaaggaacccacaacaacgataacaacaacaaacctgccggagcaacagttgagttcacaaaagatataagatcaatgtgcaaaaagttatatttagaaacactagcaatgagtagcctgaaaatgaaattaagaaagtaattttatttacaatagcattaaaaaataagactaaaacaaaagaaatgtaagactacaaaacattattgaaagtgattaagtaaagacctaaataaatagatacacattctgggtttattgaatggaagacattactgttaagatgacagtactccacaaattgatctacatattcaactcagttcctatcagaatcctagcttctattttgcagaaattgacttgctgatcctaaaattcatttgaaaatgcaagggactccgaagaagcaaaatgatcttgaagaagaacaatgaagttgcagagtccacactttattatttcaaaacttacttatagtggttaaaattgtgtagtactggaataaggatagacatgtagatcaatggaatagaattgagagtccagaagtaaattcatacatttaaggtcaattgattttccacaagggtatcaaggccattcagtggaaaagaacagtctcttcagcaagtggatgaagttagatctcttcctcacatcatacagaaaaatcaacctcaaatggaagaaatatctaaatgtaagatcccaaaccgtactcttagacaaaaacataggtgtaaatttttctgatactgacttagtaatgatttctttttttcctctccttttatgtgggacaggaaaactagaggggtttagagttgtcttactgcttttcccctatgtcagacaaggccctgataaagcagtttttctttagggcagggctttcacacagagaatagaatgctctgggcatatttcaaaatggttgctgtacccactcactctatccaccaactagggtatattttgaaatggttgcttttcccttttccttgcctaaagagcctgaggaaattttcttcagccttcatcatgagaaccagctagggtttctggaagtaacattcatgaaagtataaggggttcccaaggcgggacttcaacaagtttttaactctcaagctagtccacactcagccaccggtaattaattgactagcatttaagtgttcctaccaattactggctcctgtggcttctgctctcaggtaaactgtgatgttctgtagtcacgtgtctctctagtttttgaggaagtggtttgccctgtgacctctattctctgacagatctaagaaaagttgttgattttcagtttgattatcttttttcctgttgtgaagatgggagtgatgacttccaagttctctgcatgttggagtgggaactggaagacctaattaacttcttaagaaactgccaaactgttttccaaagtggatctagcactttacattcctggcattgtatgagagtttcagtttctctctatctttgtcaacacgccatctttctaattttagatattctaataggtatctagtggtttcttattgtagtttgaatctgcatttctctaatagctagttatgatggccctcttttcattggcttgtcagttgcaaatctttattagtgaagtatctgttcacatattttgcccattttttaaaagttgggttgttttcttacatttgaagtttattttttcttataatcaaaattttaatgtatacataacaaattgtacatatgaggtacagtgtgatgtttcagtacattttacatggtataatgatcaaatcatggtaattagcatatccattgccttaaacatttaccatttctttgctgtaagaacactcaaaatcctctcttctaactagaatatgggtgtattttaaatgtacacctatttattttctcacaatcctagaaaatgatagcttgagtcaatgaagtttcccctgcaagtcctatcaaccttgcttactttagtgaaatttaatatggtctagaaaacactgagccctctggttattctctctaacccacaaaggaagccgaacacttgataaaaagttcatcagcgtaaataagaagaatcccctccattacatacaaaagaaaaaataactggagagatcatctctgctctaaggtgattatcctgtggtctttggttttggtacgttctccccgaccccatgcccttttccctcatctttaatgagtatctgtatgtgtggcagaacagcgtgtttttaagtctctgcagtcttggaccaagctcgttttattccctactctacgagaatctcaagagcaccaggattctgtttggagttgccatggacacagagttcttaatccagtactggcttattctcaatacgaggtaaagacctagaggtgagggtctctgagcaaggtagtcccatcccatcctctgccctctctgttggctaatgttgtcctctcatcctcatcaggagaattaaaatcatgtaaagttttggtgggggaactaggtggtggtttctggggcccacagacaggaaagtttgcttatagccagttggggggaccactaattgatattcctttcccctcccagggaccttacggagtccccttatcctcagggtactgggggacaactagtgggtgtagggccaaatagtaataaccttgttatttgccaggaatggggtaaagatttgatctaacaagcttggttttgggaattaaaaaatgaaaaaaggaaaagctataatcctgaaaggcaacaggagagaaaagtgctaacaggatcttgaataaatttctccctcttagagaaagttgtactgaagacacgagacctgagacttgtgtcattttagcggctgaaccgaccccaacttcttctgagcggcagtggcgccagaagcagtctggctttcaggtaagcaggtccagggcttacagggagaaactcccaggtatccagctctgccttgggttgccctggttcacatccaaaggtgtgcttgggccacatctctggagcagaaggtggtagactgagagctttgatatttctatttctattgcacatgagctggtataaccccaaaggtatggaatttgctgctgtctgtgacccagcaaatagaaataggaaagtaatgaggtagaaaaataatagaaatagaaaaaaaattgtaaaaataaaataagcttcattctatgcctgttaatgtccttaaaaataggacatttttaggcagtgtgataacatgcatctactggttgctttcatatttcctataggggtggctgcttgccctaatggtggatgctctgttcaggatggtgacctagtgctcagctctggaagccactccacagagatggccaccgaaagggcttcagtggtcccatctcaacacctgaaacattgttaattattacagtgaaggccacaaatgggcttttattagtgagattggtgacttacaaagcagcatgatggttgttacaattatatgacattttaagatctgtgaatcagctaaagtgttttggagacagcccacccttgcataaacaggataaaggtttatgaatatggcctgtagtgtatacttagagatgacaccccaggcttgatcctcatatggtcctatctccaggaaggtttaggaagattttggcctctggaatattaggattctgttgagaatgaacctttcatgcttggagcacctaaagtacagaaagcttacagaagcttatgtaccgtgcctgcttgctactgaatgttttgttaaatgaatatctgtatgtgtggcagatttgattggagagctgcttttcattataacctggtagcctgattataaaggtgtagctaaccttcacctaactcaaacttctgtggtttctcctgtctaccaaaaagcatttaagaattctgcgtgatcacgttattttaggatagtttgccattctcaccttccttagaaggcaatttagctagctacttatgcatgtcccatgagggaagtcagtctgtgctcccaagcagcttatcaaagtatgatttcagacttcatgcaatactctccctgaaaggagttcaggtaacatgtatggatgtcttgtgtcctttttggagattagtttcccaaggaactcgcttagcagtcctggcttgtcacctggatctgaagagtaatttgagtgtcttcccattctcttcctcggtagaagatatctgaaaaatccagtaatcattcaataaggctgcttatgtcagaaactcaaattcttatgtttttggcgttttgaacattttcccctgttatgacttattagtgtattctgcatagacaacccagttgtccttcctgcagaaaagcagcagatacctctagatgcctttctttttgtaaaaggtattgtttttcctgagacctggatgaatttccatgagccattcaagggcatgagaacacccacttagaacttgagaggttcccttcatggccctcagactgggctaacgagatttgataatttgaactccagcactcctttcctcacaggctgaaagaatagcacagtattaatgtctatctgcgcttaaaggtttgagctatcgaccacagtccaaaattagtttgtgtaggagaacttttacttaaagacataaaaagataccgtttaatatattgcttctaaaatgtgtttctcacacatttccactgtgagaacgaggttctgtggtcaaataagtccagaaacctcagcatgctctagggaatcccagtttttatc

SEQ ID NO: 1785 - DNA, 12770 bp, Homo sapiens
atttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaa

SEQ ID NO: 1786 - DNA, 3391 bp, Homo sapiens
tttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaaca

SEQ ID NO: 1787 - DNA, 8645 bp, Homo sapiens
ctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagtta

SEQ ID NO: 1788 - DNA, 27801 bp, Homo sapiens
acattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatgaggaagaagcaaaagcggaaatcctgatcaaccagtcagatctcgtgagacttactcactatcacgagaatagcacgggaaagaccagccaccatgattcaattacctcccgctgggtccctcccacaacgcgcaggaattctgggaaatacaattcaagttgagatttgggtggggacacagcaaaaccatatcacccatgtcccttcctctctccgtggccggtgaccccatgtggacggaccgtcacccatgtcccttcctctctccgtggccggtgaccccacgtggacggaccgtcacccatgtcccttcctctctccgtggccggtgaccccacgtggacggaccgtcacccatgtcccttcctctctttgtggccgttggccccatgtggacggactgtgtccctcccccactcagtagttgcctctgcttgggagctcttgtgagcagtgctgctgtgtgaaatgtagaaactgaggcaggaggagactccctgtaacccaaggtcccaagctaataaggtggggccagtctcaacggacccctgcccagggcaatgctctgaccctgccctcctcagtcacaacctgcagctacactaggcccccacctctgagctgcaggagaagcctgtctcctgtgctgtcccagtgaggcagggagtgcaggtggggccacagcaccccaaaccccccagcaccccctgccccggggccacagcacccccaaaccccccagcaccccctgccccaccatcccctccaccccatctcccgcggcctccagggtctcactgacctcggctgtgcatgggaaccaagtgagggcgggattgggagcccatccctgcagaggaggctgggatcagaaggccccagcggagcccagagagggggttcatcagaccgtgactcaggctggcagagcttggtggccccagacaggatccgtccacatgagacaggtgcacctcgagagcagccgccgcccacactgcaggccaggcattggccggagccctgcgccaggtgggagctgccctgggacctgggggaccctccagccaccacgaaccttgagtcaaattgttcacattctttgtggctgggataaaggataaggacatttttgtggcaagaacaaaactgttgaccttggagttgaatatttttgaacagcttttgactctagacaagattaaaagtcgggaaagatcgatgttgtgtttgggggaagctggtgagtgcagcctcggggaagcactctgatgcccccacaccgcaccctgcgaccgagggctgacatgaggggaaggagggttattcctgtgactttgctggccagagctccagggggcatagactccctgcccagacctgcagttcagcttctctgctgttcgcacccctaggacaccaagaggtgctggtgcctgcaccaggcagcttcgggggcacagcccgagctccagggtgcccaggaaccgcccacacaagaccacggcaccatcggcgcccatagagccttccctgaggtaaagtgagagccctggggactcgggaaatccgtggcacacttttcttcccccacaggcgctcgtgagtgcatctcccggcgctccagaaacctcttggtctctgctgcttgttcagcttcttactcggagccaggcacccacagccctggaggaactgggcggtgatttccagacaggacgccgcacctccggctcgtgcccgacctcccggactggttcaaggccagtcagccctgagaggccaagaccacattctcctggacagcaagcttgtgaggctggattttataagataaaaatgacaagcagtggcgggttcacagaccagagctggctgcaggcctttcagaggcccgttagggcccctgggcccagccagccaccgttcatgtgtggatgtgcgctgtgggccttctgcccaggagcgctggacacaggatgagaccctccgtcgggcagagggaggctcccgggcagcggagggggcagaggctgtgtgagaccctccatcggacagagggaggctcccgggcagcagagggggcaggaggctgtgtctgcacgagtgtggctcccctccaccttatcttttttctcccagatccaggactgggcaggggagaaagtccccgctccacctcccaggtgggcactgttccgtgaagtaagctggagacctcagacccacacgggagaagagcggtacttgtttatcgtaggcacggggggctttgcagggagggacgtgaggccctgagagcggtgaggcctggaggcgccagcttccgaggggagagggagtgactggggaaccgtgagcggcccacagagcagagacggcgacttggtgtcttgtggcacgtctggggagcaatgggatcacctctcgcccgccctcccgccctgggagtccctggttccctgaggatctgacttcaggagttcagagaaagcctctccccacatccaacacttttcaagagacttcggctactttggggtggcgcatcctgaactcctgtcactggggcgcctgtgacccacccgggacccgtgacccactcgggacccgtgacccacccgggacccgtgacccacccggggcccgtgacccacccgggacccgtgacccacccgggacccgtgactcacccggggcctgtgactcacccggggcctgtgacccactcgggacctgtgacccacccgggatgcctgtgacccacccgggacctgtgacccactcaggacctgtgacccacctgagacctgtcctgtgacccacccggggcctgtgacccacccgggacctgctgcttcccaggcgtgctcacccgtctccccaggtgtgcccggcaggtgcatgctgggcccgcggggagctaagctggtttccacagggagtgctgcggccccagaccctgagccaaaggaccccgaaacaccgtcccccaccatcccagcggccaggggtcctgagacaaggtgcggtgagggagaagccgcggaaggacagcggaagcccaggcgccgtagctgggagacagctcaggggaagaccctcgtgccagtggcccaggcagatttgcatccggggctgggaaagacaaccgggcccctggattctaacaactcacaggcggttagacacagcgctgggcgttggagccgaagcgtccttcccttcctggcatacgtcaggagcacagcacgaggggcgggtggcttctgccctgcgcttctccaggacacagatgcacacacgaacgtgtaacgcacaacacatgtccacaaacaagaacacacaggcagggaggccggggctgcactgtctttgcaaaatcataataatagctaattaattaagggatgtgaaaacaccagaacaattgctctcagaggaggaggccgggtgggaactttcagcgccatttgatgtgagcagagcccaagccaaggtgtcaccagcctgggtctggagggccccactccctgcctggttccagcctccctcaccagtgtgcccagggaggaaaggaggggacagacttctggaacattctcccgggttctctaggaggttggccacagaagcgggatttctagaggctgccttttttttaaaaaaaaaaacaaacaagttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgc

SEQ ID NO: 1789 - DNA, 26118 bp, Homo sapiens
gatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatgaggaagaagcaaaagcggaaatcctgatcaaccagtcagatctcgtgagacttactcactatcacgagaatagcacgggaaagaccagccaccatgattcaattacctcccgctgggtccctcccacaacgcgcaggaattctgggaaatacaattcaagttgagatttgggtggggacacagcaaaaccatatcacccatgtcccttcctctctccgtggccggtgaccccatgtggacggaccgtcacccatgtcccttcctctctccgtggccggtgaccccacgtggacggaccgtcacccatgtcccttcctctctccgtggccggtgaccccacgtggacggaccgtcacccatgtcccttcctctctttgtggccgttggccccatgtggacggactgtgtccctcccccactcagtagttgcctctgcttgggagctcttgtgagcagtgctgctgtgtgaaatgtagaaactgaggcaggaggagactccctgtaacccaaggtcccaagctaataaggtggggccagtctcaacggacccctgcccagggcaatgctctgaccctgccctcctcagtcacaacctgcagctacactaggcccccacctctgagctgcaggagaagcctgtctcctgtgctgtcccagtgaggcagggagtgcaggtggggccacagcaccccaaaccccccagcaccccctgccccggggccacagcacccccaaaccccccagcaccccctgccccaccatcccctccaccccatctcccgcggcctccagggtctcactgacctcggctgtgcatgggaaccaagtgagggcgggattgggagcccatccctgcagaggaggctgggatcagaaggccccagcggagcccagagagggggttcatcagaccgtgactcaggctggcagagcttggtggccccagacaggatccgtccacatgagacaggtgcacctcgagagcagccgccgcccacactgcaggccaggcattggccggagccctgcgccaggtgggagctgccctgggacctgggggaccctccagccaccacgaaccttgagtcaaattgttcacattctttgtggctgggataaaggataaggacatttttgtggcaagaacaaaactgttgaccttggagttgaatatttttgaacagcttttgactctagacaagattaaaagtcgggaaagatcgatgttgtgtttgggggaagctggtgagtgcagcctcggggaagcactctgatgcccccacaccgcaccctgcgaccgagggctgacatgaggggaaggagggttattcctgtgactttgctggccagagctccagggggcatagactccctgcccagacctgcagttcagcttctctgctgttcgcacccctaggacaccaagaggtgctggtgcctgcaccaggcagcttcgggggcacagcccgagctccagggtgcccaggaaccgcccacacaagaccacggcaccatcggcgcccatagagccttccctgaggtaaagtgagagccctggggactcgggaaatccgtggcacacttttcttcccccacaggcgctcgtgagtgcatctcccggcgctccagaaacctcttggtctctgctgcttgttcagcttcttactcggagccaggcacccacagccctggaggaactgggcggtgatttccagacaggacgccgcacctccggctcgtgcccgacctcccggactggttcaaggccagtcagccctgagaggccaagaccacattctcctggacagcaagcttgtgaggctggattttataagataaaaatgacaagcagtggcgggttcacagaccagagctggctgcaggcctttcagaggcccgttagggcccctgggcccagccagccaccgttcatgtgtggatgtgcgctgtgggccttctgcccaggagcgctggacacaggatgagaccctccgtcgggcagagggaggctcccgggcagcggagggggcagaggctgtgtgagaccctccatcggacagagggaggctcccgggcagcagagggggcaggaggctgtgtctgcacgagtgtggctcccctccaccttatcttttttctcccagatccaggactgggcaggggagaaagtccccgctccacctcccaggtgggcactgttccgtgaagtaagctggagacctcagacccacacgggagaagagcggtacttgtttatcgtaggcacggggggctttgcagggagggacgtgaggccctgagagcggtgaggcctggaggcgccagcttccgaggggagagggagtgactggggaaccgtgagcggcccacagagcagagacggcgacttggtgtcttgtggcacgtctggggagcaatgggatcacctctcgcccgccctcccgccctgggagtccctggttccctgaggatctgacttcaggagttcagagaaagcctctccccacatccaacacttttcaagagacttcggctactttggggtggcgcatcctgaactcctgtcactggggcgcctgtgacccacccgggacccgtgacccactcgggacccgtgacccacccgggacccgtgacccacccggggcccgtgacccacccgggacccgtgacccacccgggacccgtgactcacccggggcctgtgactcacccggggcctgtgacccactcgggacctgtgacccacccgggatgcctgtgacccacccgggacctgtgacccactcaggacctgtgacccacctgagacctgtcctgtgacccacccggggcctgtgacccacccgggacctgctgcttcccaggcgtgctcacccgtctccccaggtgtgcccggcaggtgcatgctgggcccgcggggagctaagctggtttccacagggagtgctgcggccccagaccctgagccaaaggaccccgaaacaccgtcccccaccatcccagcggccaggggtcctgagacaaggtgcggtgagggagaagccgcggaaggacagcggaagcccaggcgccgtagctgggagacagctcaggggaagaccctcgtgccagtggcccaggcagatttgcatccggggctgggaaagacaaccgggcccctggattctaacaactcacaggcggttagacacagcgctgggcgttggagccgaagcgtccttcccttcctggcatacgtcaggagcacagcacgaggggcgggtggcttctgccctgcgcttctccaggacacagatgcacacacgaacgtgtaacgcacaacacatgtccacaaacaagaacacacaggcagggaggccggggctgcactgtctttgcaaaatcataataatagctaattaattaagggatgtgaaaacaccagaacaattgctctcagaggaggaggccgggtgggaactttcagcgccatttgatgtgagcagagcccaagccaaggtgtcaccagcctgggtctggagggccccactccctgcctggttccagcctccctcaccagtgtgcccagggaggaaaggaggggacagacttctggaacattctcccgggttctctaggaggttggccacagaagcgggatttctagaggctgccttttttttaaaaaaaaaaacaaacaagttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgc

SEQ ID NO: 1790 - DNA, 47874 bp, Homo sapiens
agcaaaggtctaaagatagtagtgcagtctgtaattctgtaagtggatatattggaaccataacaacagcaacagctaacatttattaagtgctcattatttattagatacagtattatgtatcatctgttattcatgtgtaaggcaggtagtgtctttattcccattttggagatgaagaaatcaaggtatacagtagttaagaaacttacttaaggtcatacgatctgtgctagctttcagattcagggaacttgacttcagaaaccatactcttaaccagtatgccaaaccaccttctatgaatttgaaaccacctcccatgaattgatgaattcataattcatcagttggtgttaatggaagtggtggaatatagccctgaggccaagttctaaattgtttaggaagtgacccaaatactgagataatcataacaaaaaaagaggagagaaaagaaaaaaaaggaaggaagggagggagggagagaaagaaaaagtccattccaacaggcactgggtattggatattatgggagtctcccataaagtataaggggcccataaccaggggactgagacttcacagtaaggaacccagccagtagaaactgggatacagggcaaggaaactttccagtaacagtggactggaataaaatcagagcaaaatcagagataaaataattcaaagtagaggcagcatttcttgacaaaagatttcttatgttatctcccctactgagggctgaagttggccccagagtgagatgcatagttataagtcagggttaatgtaatagattcagctcagaggcaaacagaagcaagggcaccgagccaggtaggccattacaaaatggcccaactgggttagagttccaggcaagagacttattttcctaactttactaacattatttctccattgtggcagctcccgcttctgtgggacatggcatcatgtagcagtgacattagatacccaaagactgtggaacagggagatgaagtttcataacataattacaaaatttaacagcaccctttcacatattttatggcccaatctatgttgttattcttttattattttttaagaaatgtagtatgttatgtaatatactgattgcagagttcacgaagccatttgggagattactgggaggaataatttgatatgaaattattatttaattatatcactttcttattctgtcttatactaacttttgcagaatgtatattatttggagagccttgtttgatatccttaacagacagagtaaacattcaagatagtacttttaggagagtagtttgaatagttttcatttgctaattccatcctcttttttctgtgaaagagaaaaacaaaaacattttattttgttttctttcatgtagtgtttatccattgcctccatattttataacagcaccaaagactagtttttctgttctgtttaaagctcatagtttcttagaactagttgtaaatactgttaagagtcccccaaacagttttttaagaacctaatttagtttcatttgtactaagaagctgttttctagatgactaacatcatatagtgttgtttccatcaaaaatattagtctggcatttgtcatgttctgtccactaaatagctttgttattattgaggtctaagctctgattttttatcttatccaaattcctaccttaggggtctagggagtcatgtcctacaaaccataaattctcatgagatgggttttatttgaccctatatattgtgacttacttttcagtctgactctggcataacattatgagacaaggaaaaaatatttaaccccaaaatatatttccttgttataccttgaaattgccctgcaaagtttcttgtgggaaaaatccacattctatagagaatccccttccccttttgttttccttcctttctttccagatacaggagttaatcaactaagaggtaggcacccttttaagtcccaaaagaaacaatttacaacccccgctctctctgaagtctgctatctgagagcttcctctgcacaataaaagttggtctccacaatcctttaccttttttttgtttcgttttttgtttttttgagacggagttttgctcttgttgcccaagctggagtccaatggcgtgatctcgactcaccacagcctccgcctcttgggttcaagcaattctcctgcctcagccgcccgagtagctgggcgccaccacacccggctatgcgcctggccacacccggctaattttgtatttttagtagagacggggtttctccatgttggtcaggctggtcttgaacttccaacctcaggtgatttgcccacctcggcctcccaaagtgctgggattacaggcatgagccactgtgcctgcctcaatcctttatctttaacctgaacattcctttctgtcgatccaagtctttagacaaactccaccaattgtcaaccagaagatgttggaatttatttaaagcctggaagccccgctttgagttgtcccacctttctaaatcaaaccaatgtatttctttcttttcttttttttttttttttttgagtcaaagtcttgctcttgtcccccaggctggagtgcaatggcacaatctcggctcactgcaacctctgcctcccggattcaagcgattctcttgcctcagcctcccgagtagctgggattacaggcgcctgccaccacgcccagctaatttttgtatttttagtagagacggggtttcaccatgttgaccaggctggtcttaaactcctgacctcaggtgatctgcctgcctcggcctcccaaagtgctgggattacaaatgtggagccaccgcgcccggccaaaccaatgtgtttcttaaatgtatttgattaatgtctcatgccttcctaaaatacatgacaacaagctgtaccctgaccaccttgggcacacgttctcaggacctcctgagagctgtgtcacaggctgtggtcactcatatttggctcagaataaatctcttaaaatattttacagagtttgactcttttcgtcaatattatgaaatgtgtctgagatacatatacaaaagaaaaatactaagatatagcatgcatccaagaaatgcagtatctttctgttaacataaattatctaaattcatataattcatgtgcatttctgagtctcatctcacatcagacaggcagcctgagatgaagaatgagcacgggctcaggttgggacctggtaaaagcaggcatcaccatttaaggagcagagacctctgctaggttgtttcacctctctgagtttgtttcctcatgtatcagttgggaatgatatcgaatttgtatcatccttatgaaaaaacaaatatatatgaagttgcaaatataggttttcaacaaaagttaacagctatcactcattggcatctagactttaagatgattccactcaagagagcgacataattctaaataagaaaatgcttttgatgtaagagtccatttcctgcctctcgggcacgccaccacagcctgaggctccattagctgttgctatctgcagttagtgatttagcttggagcatatcgggcgctgtactaagtgatctacatatgttatttcatttaataacagcaatcctttcaggaaattttggtttctgactttctaccatgactttgacctatgtacattttcttttagactatgtattcttttgacttttgtctgccttattctagccattgctttgcacaaattatggcactttatgtcatcaaaccatattagttaggaggctgtgggatgcaaataacagagaaccagacttgatctgtcaaaaaataaagggaatttttttcatatacacaactggataattcttcaccgggttctatctctgtgattcttttcactctgtcttcctccatggctctgcttgttgtatcagaaatggctgcagcagttcctgacatgacatctttgtactacactctccagaggaatggagagttgctgttttcccagaaagaagctcttggcttccttcgacaggaccagtgtaggtcttgtgctacctctgacaccatcacttagaccaggggcttggggtcattgactggcttatccctgctcttccctgagtcaatcaacggacaagaggaatggtgttacattgcttagtttagacctacacccgaggttgtggtccatgtcacccaaatcgcatgggcatcatggagcaggaggtgaaatgggtacaggaaggccgtcttgcccccagtgtcaaaggaaatgggtattagtccattttcacactgttataaagagctgcttgagactgggtaatttataaattaaagaggtttaattgactcacagttctgcatggctggggaggcctcaggaaacgtacaatcatggcagaaggcaaagggaaagcaaggcatgtcttacatggcggcaagagagggagagcaaagggggaagtgccacacttttaaaccatcagatctcatgagaactcatttactatcacaggaacagcaagggggaaatccgcccccaagatgcagtcacctcccaccaggcccctcccttgacatatagggattacaattcgagatgagatttgggtggggacacacagccaagccctatcagaatggttacaacatttcacttttaattatgacatgttgctagagggtttcttttaaaatttttttatcagtttaaggaagtcatcttcacaattaagtttttttttttaatcatgaatggaagttgactttcatcaaatgttttttctaaatctgttgagatgatcatgtggatttttttctttattctattaatgtgataagttacactcatttttaaaaacaactttagctataatggcatataataaactgcacatatttaaagtatatagtttgatagcttttgacatatgtgtatacctgtgaaactatcaccataatcaaaataatgaacatatgtatcattcccttccaaactttttttttttttttttttgagacagggtctcacactgtggcccaagctggagtgcagtggctcactgcaacctctacttccctgggctcatgtgattctccagctttagcctcctatgtagctgggactacaggcatgagccaccacacctggctaacctggctaatttttgcattttttgtagaaatggggtttcaccatttcctcaggttggtcttgaactcctgagctcaaagtgatctgcccaccttggcctcccaaagtgctgggattacaggtgtgagccaacatgcctggccccaaacattttcttatccctcctgtaatccctgtctccagccccttccctcctacccctgctccacacctgatctactttctgtcactacagattagttgcattactaattgaagttttgaaggttaaattaactttccatttctgaaataaaccagtttgatcattatgtattagctctctctcttacattaagggaacttcaaaaaggtcacgggaaaatggaattaaaagataaaaagaaaaaatataaactttatttttcaacataagctctgtcaagtttaagacacttttataagtgacaatgtcagccatttagtccatccctaaagaactgagggtcctgggatttaaccatgtcagtgcagtctttttcacattagtaactgaagaaaagtgggtgccctttaatgatttattaagattagggaacaaaaagaagtcagaaggagccaaatcaggtctgtaggtggttgcctaatgattttcccgttgaaactctggcaaaattgtccttgtttgatgataggaataagaggagtattgtcatggtggagaaggaccccctgttgaagctttcctgggcatttttgtgctaagcttttggctttctcaaaacactctcattgtaaacggattttatcattctttggctctccagaaagtcaacaagcaaaatgctttgagcattctcaaaaactgttgccatgacctttgctcatcactaatccacttttgctttgatgggccacctctacatcttggtagccattgctttgattgtgctttgtcttcatgatcatactggtaaagccatgattcatctctttacaattctttgaagaaatgctttgggatcttgatcccacttgtttgcaacatccattgaatgctctgcttttgtctgcagctgatacgaagtgcaatggttttggcacctaccaagtggaaaatttgctcaactttaatttttcagtcagaattgtgtaagctgaaccaattgagatgtctgtggtgttggctgttattttttcggttaatcattggccctcttcaattaaggcatgaacaagattaattttttccttaaaaattgatgcagatggtctgcccactgtgggcttcatcttcaacattgtctcatcccttcttaaaatgagttatccatttgtacactactgatttctttgggggattgaccccacaaagtttttgtaaagcatcagggtttagccattcttccacccaagcttcaccataaatttaatgttcttgtttcaattttagcagaattcatgttcctctgatggggctcttttcaaactgatgtcttatccttcttagtgcctcaaactagatcctgttcagacattttatgacaagttagcataagtttattctgatgcaaaaaacccctgaaatctatgcataggtttttcaaaatacacattttccataaactttttgaagacccctattatttctgtatttgtttaaccaacattttgcttctatgtttataaatgagattggggtgtaagttttctttctagtaatgcccttctcatactttagtatcaaggttatgctagccttgtaagatgagctgaggatggggagaatgtttcctattctctgttttattctctggaagaatttatataagacaggtttttttttttaattaagttttggtttgaatcaaccagtgaaacctcctagactcacaagttttttttgttctgttttgttttgttttgagatggagtctcgctctgtcacccaggctggagtccagtggcgcaatctcggctcactgcaagctccgcctcccgggttcacaccattctcctgcctcagcctccagagtagctgggactataggcgcccaccaccatgcctggctaaatttttttgtatttttagtagaggcagggtttcaccatgttagccaggatggtctcgatctcctaacctcgtgatctgcctgccttggcctcccaaagtactgggattacaggcgtgagccaccgcgcctggccaacctatagggttttttttggaaagctttaagttattaattcaattttaaaataaataaggggttgttcacagttttcttcttgtgctgttagtttttataaaaggtatgttttcttgactttttaattgactgtatgcacgtaatatgcatgcagcatgagcaatgagagtgagaccctgtctcaaaaccaaccaaccaacaacaacaataaaactctataagctctgtagtgacgtttcctcttttatttctgatattggttatttaagcttgctttctgtatttcttcattattctccatgggggtttataaatttattcatcatttgaaagaaccaacttttacccttattgatcttctctattgtatttttgttttctgttttacttgttgctgttatctttttatttccttccttatattttctttagatttctggaattttttttgtttgttttttgttttttgagacagggtctcaccatgttgcccaggctggtctccaactcctgggctcaagtgatcctccttccttggcctcccaaagtgctgggattactaaataggtgtgagccactgtgcccagcctattttatttagatttaagttgttcttttcataactttttatcaaggatgtttagcttattgcttttcagcttttcttcttctctaatatatgaatttgggggccataaactttactcgtagaatagttttaatggtgcacctcataaattttaaagaacatttacttcaaaatgggctctaatttccactgtgacttttttctttggcctatgggttattagaaagtatatttcttaatttataagcattgtgaattttctaggtaaatttttgttattgatttctagtctaatttctttatggtaaaataatttgttttgtataaattcaattctttggaatttgtggcaatttgctttcacatatgattttgataatgatctatgcatatttgaagccaatgtgtatattctgatgtttcaaggtagagtattgtatttgtgactattaggtcaaatacgtaaaaagtattgttcaaattttacatatcgttataaattatctgatatacctgagagaggtatgttcagatttctcactatgatttttaaatttctctgttttgtcaatgttgtttaatatataattttgagctatgttactaggtgaattaaaatgtagaagtattatctcttaatagagaagttaaagttttatcattttgaaatgcagttgtccctccatatccataggttccatatctgtggattcaattggggatcaaaaatatttgggaaaaaattgcatctgtactgaacacatacagactttttgtcttgtcattattccctaaacaatacagtatgacaactatttatatagcatgtatattgtattaggtattataagtaatctagagatgatttaaaacacatgggaatacattatatgcaaatactattctgtcttatgtcagggacttgactatccatggattttggtatccataggaggtcttggaatcaatcccacatggatacctgaaggccttctttgtctgatataaatatagcttatatgctattggcacatgttttcattttatatatacttaaaatctcctaatgtattattataactattgctatatttggttaaaaatttaggtttatccacgtttgcccttttcattgttctttatgccttcctgcatctttgagcttccatctgggagcggaatacacccttcagtgttgtctttaggttagactatcgatacaaattctctacatgaagtgaaaaatgttttttttctctacttcattattgaggagtaattttactggtagagaattttaggtttatagctatattccttcggcactttgaagataattccattttattctggcttctcttgattctttcaagaagtcagctgtcagtctgatacttgcacctttgatgttaatctgtcttttctctcaggtttcttttaatatgtcttctataacttttatttttagcattttttactatgttgtgcttttctttttccttatcttggtttaagtttggagatctacttgaatctgtgcttttggccaatttttgcaaagtctcagtcattatcttcttgaatatgcctctttcccattctctcttccctctcttctggataccttctatctatctaactttctggacatgcatgaatgggccccggcaacctatctgaccccatcccctgccgtactctcgttactcgcttgtctctatcttgctgtttttctaacatgccaagcatgcttcttactcctagatttttaaaaatattgcttccttagcctggaacactgttttcaagatatgtctaagactcattcccttacatgattcaggtctctgctcaaatgtggccttatcagagaggctttctctgacatttattcaaaattatcatccagacctctcctctcccatattgttctctaactctttacctggttttatgcttcttcatagcacttactacaatatgacacattatatatccaatatttatttgcttattctttgtctctctccatttgaatagaaattctgaagttctgtaagaggagagagctttttcccaccccctcctcacagttgtatcccatcccctggaatagtgcctggattagagtaaatgttcaataaatatttgtaggagaatgaatgaatgattaatagatagaagatataggaagagttctctacaggaagtaaagaaagtggagaaggcagaataacaaactaagtaagtcttttaatttgtatggtctatattttaatctttcgaatgtaaagatagtatcattgatcatatttctgttcatcaatgttacctaaaatagcaaaatgaaatattaatatgtttgaagatatagctttcattagtttaaattaactatctcatttagtttaggcatatggtccacaaatttttaagaacatttaattttaatttaaaaaattaagcctaccaaataagatgcattattttccagtgacttaatatgtatattcaagactttttcaattttttatagtataaaattattgtgattgcacatgaaaatttattatttaagcaaaatattatgagtgcttataagtacaaaggctaaaactgatatccctaccaaccacaaaaaaataggccaggcagctgggtactgcctagcctatttttttgtggttggcagagatatctctttattgtgtagatatttaaggactcatatagacccatcattttttatgggcaaaaatcccaactctggtcttctaaatgtcttttgtaaatttatttccctaaataaatcataaatccacttataatacctagacccacacaatgtgtattcgtcatagctgctcaaaaggaatccacagtgtaggtcagagctacttgatgagagaaagtcttgactctgctaataatgtttttacctcactggcacccacagtattttgccagattgcctgaagtcagcatgccttcctgatggtcatggactgttctgcttttccaggaatgtctcaaagggatcctgcctgaaaggaaagaggccatactgtgatatttcactgcttataaagagaccaagaatggcctctgtcttgttcttttagctagcttcaaacaaacttagccagcttaaaaacagaaatggaactgatgaagtcatcaacctagagcctcccgctactgcccatgtattttgtagtctagaatgaagctaataatctcaagaactgcttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaaaaattttacatattctcaccagtttagagcattacccagaaggaattgtgactccatggtccaggggattagagttagtcattaggggtgggaatttcttctcagaacgaagttagagctctgtaaccatcttatgtgaccaagtagatgtttgagaaagatctggaattaacgtaatgaaggtgagtagcactgagaatgcccatagagtctgtagcttagatgggggtgggtgtcaccatgatcttagtgttgcactttttggaaactaggtttaggtgaggaatgaagtcacaatcccctaagaagggaataatgaataaactagttatatcagcttattactttagagtagaaaacagacctcatgcaggaatcattctgcatatgtggtgaagccttcttggtgagcagacaaacaaaaaagaaaattcactttttctaaaaaaatagcacatcagacctttgtagcctggagaactcattcttctctactttagaggtgtttctttttctaataactgggaagggctgtctctaaccggagctcctgtaccacccctaaagatatcaataatttctcattctccaacttttagttttcccatttttattggtcctcaaaactttgtctttgcggcactccctgcctcatcatacttgtgacaagttgaattcctaagactcaggctcgtattacaaaggatgcaatttagatgagcaactccctggtgagatgagtggctctctggcaaacggggtggggaacatagagaactaagagtcaggaaacttggggcctatatctagggcatctgttacctaacattctgacccagactatgttttccttgcttcagtggcttaggctgcaaaataaggtccctttcacctttgacacataatccagatcttgtactttactttagtaattttagaaagaagacatttaggccgaggagatgaatgtctgttctcattgaggtaatgaggttttctaccactttatttttcttggtaaagtctttgcttataatctggcagcctttatttgtattcctttttcttcctttggctggctggagagcaagtgccattgacatggcccaaagagtatcatcttttcagccttggagcaaggagtctcagagtagagcacccccactccctccccaaatgcctgtgaatgacaaggcaggaaaaacattttttaattaagtcaattcagttgttacaagttgaattaatctctaatttagggatatcatgggaaactatttataatatatgccagctgacccttatccaaatttccatggaaatagcaatgttataacacagggtgttcttggactgctctaaaaattccagctggtttaagtatgatattgaaccgaaaaatgaagccttctactaacaaatgtgttgaagtatgcactcaggtgctcaggaggtataggcttagcttgaaaaaattcaaggcatgataccctgggctttccctcaaacctctttaattaagacctctgatattgttgtgttgtttctatctgaagtcaaatgggaattgcagaaagttttgcagttttttttttctcctccatgaggtagagattcgtctatgccaggagaagtgaagatagtcacgtctttctcttgaatgatgtaataaagttttgcaagggataaaccatgtttcacttgtatcagatttatttatcaaatgtgttgccattaagagtatgaaaatatttcagctgaggccaggcgcagtggctcacgcctgtaatcccagcactttgggaggccaaggcaggtggatcacctgaggtcaggagttcaggaccagcctggccaacgtggtgaaaccctgcctctactaaaaatacaaaaattagctgggcgtggtggcaggcacctataatcccatctactccagaggctaaggcagggagaattacttgaacccaggaggcagaggttgcagtgagccaagatcacgccattgcactccagcctaggtgacacagcaagacactgtatcaaaaaagaaaaaaattcagctgaaataatagcatatgggagaaattagccatgtatttataatacgcgtagtaaaagtgcagacgctatgactatattgcatgcttggtgaaagtaatggcaggtttgctatgttcaaaacatttgaattaatctgttcaaaccatgcacagcattacagaattgacattccagcacagtgactgcagtctgcagcagttgcagttttgtcatctatacaacgtcaaacaagatgcaaaccaccaggcttggtagatagaataccctttgagaattaagtaatcctgagatgactttgctcatcattgatgtcctgtgacgtcaactgaaggcttgtcttgcccatttcaccttgtcattgtggttattggttttctccattaaaatggaaaattggattatatttagcagaatgaacatatatttgatgctttaggtaaaatatatacagtcatatgccacataatgacttgatgttttaggtaaaatatatacagtcatatgccacataattcaacattttgatcaacgatgaactgcatatataacagtggtcccacaagattaaaattaatatttttactataccttttttatgtttagatacacaaatgtcattgtgttacagttgcctacactattcagtaacatggcatactatacactccattgcactccatgtgcgccattgcactccagtctaggcgacagcctaggtttgtagcctaggagcaaataggttataccacatatcctaggtgggtagtaagctataccatctagattcatgtaagcacagtctatgatgttcacacaacagtgtaatcacctaacgatgcatttctcagaatgtatcccagtcattaaatgatgcatgaccgtatgtattatctgaagttagcaccctttagcaaactcctgaatcattaatttgcaaccctttggttacatcttttttcttaccattataagaatttgcttaatatgaatttgtggattaaagtgatttaaagtgctctctatatcagggagattagccctttgtctgtgatatgagatgacaatattttttcccaagtttgacatttttcgtttgaaaaattttttttgtcatgtagattgaaaatttttttccagtacaataacgcgtttaacactggggatacattctgagaaatgcatcattaggcaatttctttgttgtgcaaatattgtagggtagacttacacaaacctagatggtagagcctactacacacctaggatgtgtggtatagcctattgctcctattttacagacctatatggcacgttattgtacttaatactgtaagcaatggcaacacaatggtaagtatttgtgtacctaaacatagaaaaggcacagtgaaaatatggtattataatcctatgggaccattgtcatacatagtccatcttatttatttatttatttgttcattcattcatttattttttgagatggagtctcgctctgtcgcccaggctggagtgtagtggcgcaatctcagctcattgcggcctctgcctcccaggttcaagtgattctcctgcctcagcctcctgagtaatccccacaatctcagctcactgcaacctctgcctccctggttcaagcgattctcctgccttagcttcccaagtacctgggattacagatgcatgccaccacggctggttaatttttgtatcttttttttagtagagatggggttttaccatgttggccaggcttgtctcgaactcctggcctcaagtgatctgcctgccttggccttccaaagtgctggaattactggcaggcccatagtccatcactgatggaaacactgttatgctgtgtgtgtgactatagttgttgctgttttttttttttaatccacagctgacctgaaagtcttttatgtctccagattttaacagaaagccttccccactctgagttagtagagatagtttcctttgttttcttctagtattttaattatttcatttttaaaatttaaatctttactcctttagaatttacctggtatatagtatgaggcatgaattcaacttaattttattaaaaacacctctccagttttctcaagacaattggagttgttcgtcttttcctcactgatttaacttatgtatttatgtatttatttatttatttagagatggggcctcactctgtcacccaggctggagtgcagtggtgcaatctcagttcactgcaacctccgcctcctgggttcaagcaattcttgcgccttagcctccccagtagctgggcttacaggtgtgcaccaccacacccggctaatttttatatttttagtagagatggagtttcaccatgttggccaggcttgtctcgaactcctgacctcaagtgatctgcctgcctcagcctcccaaagtgctgggattacagcactcccaaagtgctgggattacagtggcatgagccactgtgcctggcttagataccctgtgtatcatacaccaaattctgtatgcattgagatctatttctgaatttcctgttctgttttcttgatttgtctattcctgtgtcaggaatacaccttcaactattgtagctttatattattttataataaatgctaggaattgtccccctcattttattctcttttagagatttctttgaaatccttgttttatttttttctgtataattttcatttttgaattgacacataataattgtacatattaatggagtacatagtgatgtttcaatatatacaatgcttagtgatcagatcaggataatcagcatatccataatctcaaacatttataatttctttgtattggaaaaattcaataccctctcttctagctatttgaaaatatgtaatattgttaactatagtcaccctatagtgctataaaacagaacttattcttcctgtacagctgtaattttgtgtcctttaacgtatctcaccatcttccccttcccccatctccctatcctctagtaacttcttttctactttttacttctaagagattggctttttttttagctcgtgcatatgaatgagaatatgaggtgtttaactttctgttcctggctattttcacttaacataatgttcttcagtcccatccatgttgcaggaatcacaggatttcattcttttttatggctgaattgtgttccattgggtatatataccacatttccttgattcatttatctattgttggacatttaagttgattccttatcttagctactttgaatggtgcagcaataaacatgggggtgcagatacctcttcaatgtactgatttcctttcctttggataaatgctgagtagtgggattgttggttcatatggcagttccatttgcagttttttgaggaatattgttctccatagtggttttgttggtttacattcccaccaacagtgtgtaagtgtttccttttctctgcatcgttgttttttgtctttttgataatagctatcctaactggggtaagatgatatctcactgtggttttgattggcatttccttcatgactagtgatgttgagcttttttttccatgtatttttttggataaatgtatgtctcttttgagaaatgtctattcagatcatttgcccattttttaatcagatttttttttttttgctgttgcgatgtttgatttccttgtatattctggatattaatcccctagtggatgaatagtttgcacatattttctccattctacaggttgccttttcactctgttgtttcttttgatgtgcggaagcttttcagttggatataatctgttcatttttgcttttgttgcctgtgcttttgaggtcttattcataaaatcttgccccagaccaatgtcctggaacttttctcctatgtttttctctaggagttttatagttttaggtattacatttaggtctttaatccacttgaagttgatttttatgtagagtgagagatggaggtctagtttcattcttctgcatgtggctatttagttttcccagcaccatttattgaaaagattgttctttcccccaattaacgttcttggcatctttgtcaaaaatgggttgcctgtagataaatggattaatttctgggttctctattctgttctactgatctgtgtgttattttttaatgtatactttagaatttgtttgtctcattctcccccgacccctacccttctccaatttttggccttgttactgtagttataattaattgctaaattagcttagggagaacaactttatgaggttgagtcttcctatctaactaacttggtatgtcttcccctttgtacaagtctttgtgtcttcaggaatgccttaaaattttattagtaaatatggcacatttctaaagctttttcttaagtatttcatctttttctgttgctattgtagatagtcttcccccatttcatcttccaactttctgtgtttgtaatctaaaatctattgatataataattctctatcgtgctgcctaagttttcttgtttactttttcaattgaatgtcatagggttttctatattcatcagaaattgtagtagttttattatgttctctaaatttttatacctctagtttctttctcttagtaattgtattgtctaatatctaatatctaggatgttaagtaatggtggtgacaaatgagcatccttctttgttcctgaattgagtgggaatacctctagtgttgtcctgctaggcataatagttactttgggatcaaggtatattttatcaagttaagaaggtatccacttatttctaccattgatttcaacatatttctaaatcatagtaaagccccagggctatgtacctgcaccatgataggataaaagctctaaaaggaaagacacttaagaccctctagtctaccttcctcccatcatgagtattaaattccaagcacaggaaggttgtaactattccctgccccaaagtcctaaaattagattagaagacaatttggaacactgtctcttaggtcttatagcagcgttttttggggtatgttaggctaacactatttctctataacattatttctcttcctttgtgctctctccttgagatttttccattttatccttctcttctcatctcacttctgggacttcacgtgtattgcttggctgtgcattcttcctccagcctgccattgctgacaagccaagtttatcttaggagagttctagacagtgacataatcccttccccacccaaaaagactctttgctatttgctcttcctggacaaagtacattgtcttccaaatgctgttggttacatctggaattaaagcagaaagctcattggagctgctgaacacctcaaaatatacttcagtttttacagtgcctttagcaaggtgattttagccaacagtgaaagtatcataggcactactgtatcttatattcatttgtaggtggtattcagatttcaaaagaaattgtcataatatttattatatttaaatggaaaacataaacaattacatattagtgctatacttctgattttagattcacctgtgtcataactttaacatcaaaattagtaaatgtttcatatgctaagaaaacttatatgcaaatggaaaaaatctaagccaattattattttcataatgttctactgtgaaacaaaagatagtatttctgtccatatgtagttatcagactctggagtcagatagacttgggttagaattctggatttaccaccacctggctgggtgactggacagaagtaacatattctcaactgagtctcacattcctcagctgcagaatggggacagaaatactttgtacagttatatgagaattaagaaaatgcacacaaagtgcttagccagtggctaccatgccctaagactttaacagatgataactattaccatagcctattgttaatggctgtaataaagcctgttgtttttaacttttattaacttaaagaataaatgttgcagtttgactcagtgtgggactataattgcaaagcaactcatttatccacacagcctcctttctgagaattagaactaatgtacttagaaggatttgactgaagttctgctctggattttcttaggaattatttgggcaaccatgtccattaacacttatctagaaccgcaaggctgaaagtatgttattgtttgattaggttttcattagccaattattatttattgaccatatgataggtggaatagataagtatcacaaaagacatacgattcctactctacacatttagaactaaaaacagaagggcatctttgatttacttaaagggtccactttgtgctagatataataccatgccctagggatacatagatgaaaagatagccccctactctgaagaaacttatggtctagtatggtgtctagaatggaacttagaagccacttcttataggaagccttccctaaacttcaggtagggaaaatttccctcttatgtcatagcccccaagcttacacttaagtttggcatttgtcacactgtagattgtctgtctcctatgctagactgtaggctgcttgagaacagggactatgtcttactcatcaccgaagaaaagaagatgactaaaacatcatcttggcccttgaagaacttaaaattgagtgacaaatataaactacgaacatctgtaaacaactaagctcaaaatacatttttatgaattataaattctacagagtatatgctacaagaggtaggaggttttggaaagatgatttagaagatacggcatttcagtttagaaggaatggtgtgatttccatggttgaggtgggcaaatgaatccaaggttaaggaacatcatgagcaaaggcacagaatcgggactgtacatgggctacttaaggaatagtaaggagttccatgtgagtggactctggtaagaatgttaggtaggggattggttgtagctgatcttggatgcagtagtagggtgtttggattttcttctgcaggcagtggtgcattgacaaggatatttgagcaaaagggacatgattactttgtcaatagtgtaaatgatgggaaaagagagataatattcaggaaggggactcctgggactgccaataatgtagacaagaggtattaaggtgagaatagatatggaaagggaacaattctggaagcattgtgcaaattgacttgtcagactctaatttggaataagggcgattccaatttaaaagtccttatttcctacctcggtggagcttgcagtgagccaagatcgcgccactgcacaccagcctgggtgacagagtgagactccgtctcaaaaaaaaaaaaaaaagagtccttatttcaaaggtgatggctctagtttacattctccgtcatttacatgctctggccatggcatgggtaaagtcactcagaaagcgtttaaagaaaagccagagggaggtcacagaaccttgtggaaaacttatatttaaggggtaggtaaatcttcatatttagaagagattatgtttcaaaacttactaaaaagacaaaaatgggctgggcacagtggctcatgcctaaaatcccagcactctgaggccatggcaggaggattgcttgagcccaggagtgcaagatgagcttgggcaacacagtgagaccttatcactaccagaaaaaataaataaattagctgggcatggtggcatgtgcctgtagtcccagctactaggctggctgaggcagatcacttgagcccaggaacagtgaggctgcagtgagctgtgattgtaccactgcactccagccttggcaacagagcaagaccctgtctcaaaaaaaaaaaaaaaaaaaaaaaaaagaaaactcacatagttttcatcctttaagtggtttgcttaagttaacatctggtttatggcagagcccccaacccctgacatgtagctcagtgcactttctattttatgctctagattttagtttaatgctaaatgtgaggatatcacctaccttttccatcctcatctatcttagtaaaccggattaaatttgaattctggacccctctactttaagtatcttctatctcagccaggcgtggtggctcacgctataatcccagcactttgggaggccaaggctggcagatcacgaggtcaggagttcgagaccagcgtggccagcatggtgaaaccctgtttctactaaaaatactttagctcggcgtggtggcgcacgcctgtaatcccagctactcaggaggctgaggcaggagaatcacttgaacctggggaggtagaggttgcagtgagccgagattgtgccattgcactccagcagaactccgtctcagggcaggtgggtggggtggggggggcgttgaaagtatcttctatctcatatgttgatagctaccaatagcaaagagaaaattgtgccactggaaaacagggcaagtcatctatatggatgccacttaaaattatgtgatatgaattgatataaaaagcctaattaaatctaccttatgtttcaaaggcggtaagttaatcttttacattattgtttttatactctactctttatgtaaaagaaaaactacttcattttcaaatggtaaattattatcacccaaatacattgctgtatacagaagtggaaagattttgctcaaataagccaaagctaatgatttcattataattctatagaagtttttgttggtactaatactgtaattgtctatagcatatgccataggtattgtttgaaattgtttttatctcttaattatcaaatgaaatatacctcaaagagggaggcctgaaaagacatgaaactttgaaatatagagcatcttaaaaagcaagtacatggtgacgccagtcttcagaatagcatcatccctgttgaacagcataaaaaatatatggatttgatgatctatttggctggaagataaaaaatgaaccatcatgagccattattaaagaggtgtttataactgaaaaactgtgataaaggtcagttgacaaaatgagtggagcactgtaaatactaagagttgatggcccatgcctagataattcagtgtttctattcttagaaaatggattttaaccatttgaatgggcctagtaaatgatcctattacaattttcacatatcaattcatggtttacccaaaaagatgtgcagcatacttttaaattggcctttttctggcagagagtttccagaaaaataatgtgtttttttttgttttgaatttatttgcttactttgggtttttcttaagcaagaatattaaagtacaatatacatacagagaagtatgttttctaaatgtacaactcagtgaagtttcacaagttgaatatacttacttatccagcacccagatcaagacacaaaacatcaccagcgcttcagaatctaccatctcttacttccttccaatcaataggtacttaccaccctaaaagtttattgggagacaattctcccatgtgtctcatgtttctgcatatcttgtgagcaaaggcactgactgcgtgtgttcagaatgtctttccaaggcagccttggaagaccatgtctccagagcaaagggcaggtgtgcttatagtcttgaaaatagagattatgtcccttagagagcaaagaacaggtttacttactattcggtataatagagatgtctcccttcaaagcgaaaaggacaggcatgcttactgcccattataaaagattcagattccctatgttccctacaggagttcctctcctgtaacacaatccactgtatgtacaggtgtcacttgactttctgttgccttgtgggaattagagctcagggaaccagtgcaaacactgacactctgactattgagttgtaaggtcctttgtctctgacctagcatgtaaggctaacttgttaagcttgcaaggagcgtaaatctcagacccgtcactgtccttggtagtaagcactattctgacttctaccaccatagattagttttacctgctgttacacttcatacataaaagaattatatagcatgtactctgtctggcttcttacatccaacaacatatttgtgagattcattcatattattgcatgtaggcataattctttcttaatagtataccattgtgtgaacattttaaaaaattgggtttttttttccactattgatggacattagggcagctcccagtgtcagctattaaaattctgttgttagaaatactttatgcatgtctttgagtgaatatatgtatatatttccgttgggtatattcctagaactagatcagagggttcgcactggtgctgccaaacaactttctaaagtatctgtacaaagctgctctcccataaacagtatatgggccttttggtatctctgttattttcaacctttgttattttccatcatctttgttttgttttttttcagtgacatgcttcaattttaccatcatccattcataaggaaagatcccattggcataatggaattataccattggcataaaataaatatgccaatggtcgggcggatcacaaggtcaggagatttgagtccatccttgttaacacggtgaaaccccgtctctcctaaaaatacaaaaaattagccgggcgtggttgcgggcacctgtagtcccagctactcgggaggctgaggcaggagaacggtatgaacctgggaggcggagcttgcagtgagctgagatcgtgccactgcactccagcctgggcgactgagcgagactccgtctcaaaaaaaaaaaaaatatgccaatggtataattccaatttcacaaaacaatctcacaagcacttccactctttaggctgaggcaggtgaatcatgaggtcaggagttcaagaccagcctggccaacatggtgaaaccccatctctactaaaaatacaaaaattagccaggcgtggtggcacacacctataatcccagctactgaggaggctgagaaaagagacatgtcaattactaagttgttaccaggacaagttatcaaaaaggacaatgaaagccataaatattttgtagtttatttacccatgaacacaatagtttccagtcttccgcatcagataagaccaagttattcaaattaaaatgttaaagatacggttttaacagaaacaagaacaggctgaaaactgccatgaatatccatatccacataatgtacaaaaaagaaagactgatattattccaaatatttctatttgaaagtaaaagaaaatctgtacagctgaatcttcccagtaaacagaaagagaaaatattataacacagtattaatcttccacataagtaaggccatatgcaaacaagaaagagaacacccaaaattgcagtgtttcttcaaagaacccttctctagggaacatatttaacactccaaccatcttctattcttctacgtgcatactaaaaaaaagtacttctcttcccatcataactagtcaacccagtgtaaattctaggcccgattttcccctgaatcatttctgcctttttgttcagttttccctgcctagagcacccatcacaatctctttagttcttctatccactctgaactagaaatcacctttcattccatacagctctgtagtcctttaaaccctctaggaattgctaaagaggggtgaggggctgagaagaaaggagaatgggcaataagaggtctggcagtctattttacagaacagcctgcctctggacatgacaaagagagccaagaaactaaaaagcctgcttctgcggatgtttctgaactactacttttgttttttttaaaggaagacagaagagatttatgagagatgagagaaaagaaagtgtacactcactctggcacttcattaggttcaggaagggaggcaaataaaggtacctagattttgaatgaatccactggttgtggctgagaaagcctggtacttgtcaagaacaccaacatattaaccttgccatgaggatagggtctgacatgtcccctcaaccacctgtctaacaaacagtagggtttctgagtgatgagggtggtggtggtaaagagaggtcttttggaagaggaacaggtcttttgtgtgctgacaggaaagctgtgtccaccaccagtgttctggagatccctgtttattagaaaccagagagtggagctggcaatggtctgggatatgttcactcagcagggagctgcccaagtagcagtacttgggaatagccagtagcaggcagcaataggtgaccagtctcaggaaaagtaatggggtcccataattcacacagaccaacttgccccctgctgttctcccttgacttcattaatgcccagcaattgtccacaggccatgcacctgtactgtcagatgcagagcagggtgagctgaataggttcttagacacagctagaaatccaagtaggaggagccagaccagaggtcctgggaacaaaccgagtccaaacaaaggtaaatacagtgtaacctacagcatcattcgcttcgcttagaaggatgtgacccatcggctgggagcatgtgatgttaatgcagaatagcaagacgaccaggtgaaaggggagcagcacagccaccaaggtctcaatcttcaggttgagagaacggaaagtttaaacagagggtacaggaaagtcagaacaaaaaaagtaaagggcatacctaatgctgttgcccaagctcaggtccagctggtggtggcaggcaaccttctgcaggagtaattccaaaggcaaaggttaaccacactggaacccaaagggcctggggatctccactggctcccttaccaggcgacgtctagctctatgggcgtcttcacccaacaggtagtactgcagtggatttgaccagaggtcctctttaataatctgagcaatcctgtcggactctggaaggctgtggtctgaaaaccaggtgaagaagctgcagatgacatgtcggttcctatgaatgaaggactggggtccatggccccggcgccacatgattagagtggaaaaagacaccacttggccgaaggatctgacctcatacacctttacaatcagcttgtttctgaagtaagggtttctttgaaagaagaacttaaacttgcagcctgtcctagggtgtctgagctccttcacttccaaattggttaagtagcttaacatctcggcatcttggcctctaatcatggcagacagctgtgggtggtggcggaaagcagtgacccagaagcccgggatattgcgaatgatgtcattcctctgctccaggtagtattcatgaatctgcccaaacctgcgctccacctgcaggagcgccctgtcagcctctgcattcacggagtccagttccagctggatggactccagggggttcaggtggagacccacgttcaggggcccgggcccgggcccaggccctgcctccctgtttacctcatctattgctctgttttcttccgccacgtccatttcttcgcctcctggcttctcatccactggggctgagaacatggcacactcctcaggcttcacgtcctcggccttcccctctgcaatcacttcagactccgacctccctgccccacaggtttctagagccttctccccacctaggccgtgcgtctcttcacccggaaagccatttttgaggctgccgtcagttgtcagcgaggcagaggccgcttctaggccctccgcgggtggtggagtcacttcctgccccgctttgatggctccatgactgcgacccgcatcgaccaagatgtggaaagtatggccaccatctgcgggatcctggggcgcgaccccctcctctggaagccggggcggtgggaacacgattggctccaagcggccatcaaacatatctgccattacctctgtcgccttgctcttttctcgggacctctggccctggtgcgggtcttccagagcatagtcgagagtagcggggctgtgaggactctccgggaggctcatgttggtagcggccagggcagcagtgggtagaggccaggccagaggtaggtagcgtcaacgttcctcacacaaaatggcgagtaaacacctcgcccatttgcgccgcccactcttcagtctcgcgacacccacccctcagtctcgcgacactcactcctcagtctcgcgagtctgtggtggtgtctttacgtctttgttattttagccatcgtgctggatgagtaatgatattacatggtggttttaatttgcatttagccaaagtctaatgagctgagaaccttctcatgtgtttgttggccactaggatattctctcttgtgcagtatccgaggcttctccctatttctctactgggctgacgttatttttcatatggatttgtaggaagcctttgtacatgctagatactagtcagtcattcttccagtataggtattacaaatatttctcttccagtataggtattacaaatatttcctcccactctgtggggttacttttcttttggactcgtagtttcgctgtcgccgaggctggagtacaatggcatgatctcagctcactgaagctgccgcctcccaagttcaagcgattctcctgcttcagcctcccaagtagccgggattacaggcgcccaccaccatgcccggtttttttgtttgtttgttttgttttgttttgttttgtatttttagtcaagacatggttttgccatgttggccaggctggtctgaactcctggcctcaggtgatccgcccatcttggcctcccaaagtgctgggattacaggcatgagcaaccgtacctggcctactttttcaccatcttaatggtaccttttgaagaacaaaagtttttcatcttaatatgtgccaatttgtcattttcccctttaccttagtgtttttctgctctgtttaagaaatcttacctctcacctgggcacagtgcctcacacctgtaatcctagcactttgagaggcggagacgggaggatcagttgagcctaggagttggagaccagcctgggcaacacagcaagaccccatctctatttttaaaaagaagaaaaaaagaggaatcttatctcaccaagattgttcaaatttatatatgccatccatctggaattgatttttatgagtggggtcacaatttctttttttccatatgaatatctaattgacccagcactgtttattgaaaagacaattctttccccatgcataggtttttaaatgtttctgtcagaagtgacataaatcattggctacagctagtcagttggccttgtctaactttaataggacagggaggtgtaatcttctcttgagcctggaaggaggaaactggaaatattggcaagtgctgtatcactcatcatgaaaaataatttgagaaatatataaaagaccaatagaattaggccaaaggacatagagaaaaggtaataataaacaggagaaatttatgtaagacaatacagagcattaaccaaagattaataataaaaggagagagaaaataagcaatatttggagagaaaattatagtcacattgatggtttaaataaatataagacaggatgttagacagctttatgccaatacattttcaaacttagatgaaatatatggcttcatagaaatgtataacttatcaacacggactgaaatgcaatagaaaatctaaatagacctagagacaataaacaaatggaatcagtagcttaaaaaaatgtttccacaaaaatagcatgaggttcaaatgattttgaggcgactgctaccaaaccttcaaggaacacataatccatttttatatttattaaacattcaacaaatatttattaaacattcaacaaatgtttattgggtacctactgtgtgcctggtactcttataggccctctggatataacggtgaacagaccaaagatttcttccctcttggggtttacattttagcaggggagaaagataataacaagaaaccaatattgcacattagaaagttataagtgctatggaaaaaacaatagagcaaggagattgaaagtcctgggggtagggagtggggaggagattgtagtatgaaatagggtggtcagaggaagcctcattgaaaatatgagattttggcaaagagtcaaagaagttgagggagtcagctagtagaaatcctggaggagagcatttcagcacgagaagtgctaagcagaggcactaagacaggagcatgtctggaatgttcaagaaataacaaggaggccagcgtgactggagcacagtgaatgagggaggctagatcaagtagggtcttgtatgatagtgtaagaaatttggcttttattcttagtgaaatgggaaattactacaggattttgagcagaggacacaaaatctgacttaagttttgcgtgaatcactctggctcctgggtgaaaaataatctgtatggtggcaatggtagatttagggggatcttttgggaggctactgcagtaacccaggtgaaagatgtttctcagaccaggtggcagcaatggaggtggatggtggacatagtatgatggtagagtcagcctgatttaatggtaaattggctatgggatctcttagttcattttctgttgctgtaactgaatacctgagactgggtaatttataaagaaaagcttatttaactcacaattctggatgctgagaagtccaatatgctgtgctatgaagtagcatgacaaaaaagcagaagagcaagcaagcacctgggaaagaatggacaagagaggctgacttgcattatagcaacccactctctcaaaaactaatccattcccatgagaagttatccagccttgcaagaaaaacataaatccatcttaacaacctgatcacctcttaaaggccccacctcccagcatggggtgtaagagaaagagagaagtcaaggatgactccaatgattttgacatgagcaactggtaggatggagttactggaagcagagatggtgaaggttataatgaggaagatctttgcaggaaaatcagagttgtctctcttttttaacatattgtttgagatgattattggacaccagagttgagatgccaagtgggcataatgagtttagagctcaggagaggtctgagatagttattcacattttgggataatcagcatgcatggaatttaaagtcaaagggttggatgagaacactaagatagtgagtcctgataagctgggccctgaagactccaaaagtataaggtcaagaaaaagaggaaaaacagcaaggaagactgaagagagaccagcagggtaggaaggaaaccaagagagtgcaatgtgcttgaagccaaatgtgtaaaggaaggtgttcagctgtgtcacagggtgctcacatgtcagttagtatgaggtctgagaattgaccgtcggattttacaacaaagagtcactggtgactcaaaaagagcactttcagtggagtggtgggggttgaaatatgtttgaaagggaaagggagaaaagaaatggagattgaatattgacaattcttttgaggaatttttctccaaaaagaaacaaagaaatgggatcatgacaagagtagtcaagctactttcagtggagtggtgggataatagcttggctggaataagtttaagagaaaacaggaagcgaaaaagtgaaaacagcgagtatatacaactgttttgagaagttttgtttcaaagaaatgggatgatagctggtggggaaatggatcaaagaacgtgtttttaaaatgggagatgaagcatgtgtaaagaagcaggttgatgtgaatgatccagtagggagcataaaactaatgatgtaagagacagaaggaagcattattggagggatgtcctggaatagacaagaggaggtggaatctagtacctaagtggagaaggagatgtcagctttaggagcatggcaagttcactagtggtaactggcaggaagtcaaagtgtgaggtgtatatgctagtaaacaggtagaagtgatagtgagatttatgaaatcgtcttctgattgcttcattgttctcagtgaaatagaaagcaagatgatcaaatgagtgtgaggatggggcaacaggcagtgggagtctgaggacagagaagaaggtatgaaatagttgtctagagagaagagtgactagactgtgacctaaagtattgtcagacaatgttaaagtcatgaattggaaatgaggcccatcagcatggctatgaatttttctccagccgcattcaacttacagctgcagtgtgaataagcagagttggatttagacctgaaacaagaagggcaagagaataattataataattgatcttagagtttaagctggaggacggaagacatacaggatgaggtcagtgaaaaggtggtctgatcaatgaattggaagattcagggtactgaaggtctcctggggtcgagtcctagggagaataagctagagggctgagagacagtggtttgagaatgacctgcaagggattagtcagaatcccattcatgaatccaaggtggtctctaatgaggtagacagaggatagggtaaggtcattgcaggggaggaggtcaatgagccaacaggccaggatgggaaggatagtctatgtgtatattgaaatcactgagagataagacaagagagaagtgagaatgaggcaggagctaaaaaacatgagaaatgagagggaatgacatgacagtagcaacgttttagggcaataggtggtccaaaccattgacaggagactcaaagctggatatgtattctagggccaaggtatatcaccactacctttcgataaaatcagttagtgggaaggcagacacctttagaattttatatttcttaatgtcacagaccctggtattatacatctccccaagggtacacatacattaggaaacatgtattttttaaaattgaaaggtgagtagtgatattattctttgagttcattgtgaagtgttattttcttttggggttccattctgctttgttttaaggcatggactagaaacagttgaaaagaataatatacaatttcaactttggagcctgaaatattctggctataatttttttttcctaaaaaaagggagaacaaggagagctatataaaatctctgaaatgttttgtcaactagaggcagaaataaagatgtggagaaagagggagagggagaaaaaggaaagaaaaatgaaaaatgagtaagggaaggaagaacgatatggcttcttgggaagagtacaatttagccactaatctgcacatcacagaattgtaaagtgtttaaattctctgggaaacagaaaaacatgatgttttaaaagataaactcaatattagatgactgaaaagagcctgtgaattgtatagtcttgttttccttggactcctcaaatattctttttcagttcttgttttgaaagggatccctctctcttgacttaaattctttaaacaacattgtttatatagtgatttaacatacagaactatttttcttagaactaggccacccagtttagaaagctgagggcctgaatacaatatgttactttcgtaagattcaaaagaatgttggtaaacaagagagggagatgtacactttgctaatttcttctgtttcccatggaaagtttatcaaactgtttgtgaaggaaatggtcaaaaagaagttttaagtgattaaccaagtagctttacagctgcagtcgtctttattgtatataaatatagataagagaggagaaaaatatttgagttaccagggcatgggaaatgatttaccttggcaaagttaataaattatgatttaatcattttctactaatgtagcactcatagaaagaaaatatacattattgtgcctggtgaaactgtaaaaggctaaaaggtctatgtagagtcctggcctgatagactagccccagagtgtttcagccaggggtgagcagagccacaggcttgtgactggacctgtgtcctggctagtgtcaagcatccccaccagtgaatgcgatacaggagcaaaatgatgcaactgctgttacagtgtttatgttacacaaaaccaaaataccagtatttataccagactcttattttaaaagtgttcagaattcaggaaatacaacagtgaaactaagtaatacgttttaaatgcaaattttaaaatagatattataaaatgtttctaatatctaagtgttagacataatcactctagcctaatttagataaaaatttttaagtattagaaaagaaattgatactacagtaaatgaataagttggttaatcatggaaaattgaaaatgaaaaagagtgcattgatgatgtcatcattaccataagagtattttttggagcaaattttttccagctgctataaaagcttccagtttctacactggtggcagagaggtgaacagagttttgctctaattcctattattttcttgagttgtcattttaggataatctctctgtgattactttttttttttagaaataactttttatggatggcaaactgtagtttttgtttcaagtaaagcatttctggttttaactgtatcatctttaatttatcctgtttgaatatagattaggtacaactgtatcaacctaattaattactgtcccattcacattccactttattgaacggtctttgaagtaggagtaagatttatgtatgtgatagaaggtttagaagctgggtgtagtggctcatgcctgtgatgccagcactatggggggccaaagtgggagaatcacctgaggctggagtttgtgtccagcgtggacaaggtagtgagaccctgtgtgttaggtcattcttgaattgctataaaaaaatacttgagattgggtaatttataaagaaaaaagtgtaattggttcagcaggctttacaggaagcatagtgtggcatctgctcatcttctggggagacttaaggaagcttacaatcatggcggaaggcaaaggggcaacaggcacatggcaagaggaggagagagagggaggtgccacacacttaagtgaccagatcttgtgagaactcactcactgtcaagaggacaacatcaaggggatagtgctaaaccattcatgagaagctgcccccatgatccagtcatctcccaccaggctccacctcgaacactggggattacatttcaacatgagatttgagcagggacaaatatccaaccatatcaccgtgtctctacaaagaaatttaaaaatcagccaggcatggtgctgcatacctgtagtcctagctactcaggaggctgagatgggaggatcgcttgagcccaggagttggagcttccagtgagttatgattgccactggcactccagcttgggtgacatagtgacacaccctgtcgaaaaaaaagctttgggttgtccattgatattttctctttcctttggaggagtatagagttgctccttcattcttttcaaattttaatatagtgtataactctttgcatatgtttcaagatgataattcagcaccttttacagtactggataatcatagtaaaataaatataccagaatttcattattttaacatacaccatatactgaactgccagaatactgagagaagatattacaatcactagttgaaaccaggaagccagcttcagtcatcaaatccaaacaaacagtgagcacaggaagagcagtaagtgcctatttattgaccaccttttgtgtgtcagggaggtgatagatgtttagtggtgaatgaaacaggcatggatctgtgtccagaattggttccatctggtgggttcttggtctcactgacttcaagaatgaaacgacggaccctcgcgatgagtgttcttaaagatggtgtgtgcagagtttgttccttcagatgttcagaagggtccggagtttcttccttccggtgggttcgtggtctcgcttgatttcaggagtgaagccgcagaccttctcagtgagtgctacaggtcataaaggtagtgcggacccaaagagtgagcagcagcaagatgtgttgtgaagagtgaaagaacaaagcttccacagcgtggaaggcgacccaagcaggttgccgctgctggctctggcggtcagcttttattcctttatttggccccgcccacatcctgctgattggtgtgtttacaatcctctagctaggcagaaaagttttccaactccccacccgacccagaagcccagctggcttcacctctcagatcctgctcagggagcttagaatgaagaaggcagaagcaggagactagccaggaagggcggaagccaggcagacagtgctgcaaactcacatgtaaaaaacaaggtgggaggaaagggagaaggtccaaggtaattgcccaaaaagggatgccggtctggagatgggtggatgcatattatacagaaacaagtagaaatcttaatgccctttcaaaaatataagtataaatttaggtggtgagttgtttcaacaagatacatgatccttgtttggggtaggggacagtaaagctctcaaaagcattcttgggacagtggaggaaattaaaatagggactggatagtaaatgtttaaaagaattacatgaattttcttaggtgtgataaatggcattaaagtatagaaaacagcattcttattctcaggaaaggaattttagtatttagaagtcaagtgttaaggtatttccaacttaccttcacaaagttcaactacaatgccaaaaacaaacttatggggagagagggaggaaagaaaatatagcaaactttaactaggtggaattatgtagctatttgattgtactatgctttctatgtatgtaggaaaatttgtataataaaaagtagggggtcaaaagataagcatgtgtattagtccattttctcactgctgataaagacatagctgagactgggaaatttacaaaagaaagaggtttaatggacttacagttccacgtggctggggaggcctcacaatcttggtggaaggcaaggaggagcaagtcacatcttacatggatggcagcaggcaaagagagacagcttgtaaatggaaactcccatttttaaaaccatcagatcttatgagacttattcactatcacaagaatagcatgggaaagacccacccccatgattcagtgatctcccaccaggttccttccacaacacatgggaattatgggagcttacaagatgagatatgggtggggacacagagccaaaccatatcagcatcctactctccttttgacaatggatgaggcagctgaaaggaataccaaggagaaaggggaagaatgcagggtgtggcctattatgactttgggcaaacgcttaacctctttgagcctgagttttcttcctctgcttcacagataaatatctacatacaggggtgatatgaagattaattaaataagttgaaatgtagtggttaagagtggtaagtccaaatctcaaactgcacttagttactaaataaccttgggaaagttacttttgtgcccagtttccttatctgtaaaactgacataataatagtgcctacctcccagaattgttgtgaagcacagaattgttctaaagagcgaagcttagcatatattaagtatttgataaatattggctctcattatttttgctatctaggactcagcatcctgaaaatagagaataccccttcttttcacgtgcccattggacattcacaaaaattgagaatttattatgcccataaaaaaacctcaatatattgcaaaaagtagagtgtgagcagcatgttctgagaacagttctgtaattgctgacataagtaactctctaaatcaactcttgggtcaaaaaggaaataaataaattacagaacaccttcaaaataacaataatggaaacctcatatactagaacttatggtctgcaactaaaggactttttagtattacttgtgaatattgatacaaaaatactggataaaatatgagtaaacaagatccaccaacacactcaatcatttaccacaacccactggacatgcccatgccctttcaaaaatataagtatatgatccttgtttggggtaggggacaggaaaactctcaaaagcattcttgggacagtggaggaaattaaaatatggactggatagtaaatgtttttccaacaattttgttttagcaaattacatccttatcacaacaccctataaaccaggtactatcattggccctgttcaacagataagaaaactgaggtgcagaaatatatagatatagatatagctagataaagatagatagatagatagatatagatatctatctatctttttttttttttttttttttttttttttttttgagacggagtctccctctgttgcccatgctggagtgcagtggcgcgatctcggctcactgcaagctccgccgtccgggttcacgccattctcctgcctcagcctcccaagtagctggtactacaggctcccaccaccacgcctggctaatttttttgtattttttttagtacagacggggtttcaccgtgttagccaggatgttctcaatctcctgacctcgtgatccgcccgcctcagcctcccaaagtgctgggattacaggcatgagccaccgcacccggccgaggtgcagaaatgttaatttgcagatggacacataggaaatggcgaggcgaagaaatgaacccaggcaatctgagcctataaagctcttccttttaaactctacggggtactctctgagccattctcagctacaaaagagggttagtaattcttatctcttgtggtggacaaggtaagatacggagttgagtggggagaggcattgatgctatctttatctgtttctgtattgttgagttgttataatgagcatgtattattcatgtattttttcatcaagaaaatgttttttaggggcctataaaagtgcctggcacaaagaagctcccaataaaaacattattatgtctgaaaggaaattcagaatttccatttgacttaataggaattcatcagctccggaagctgggtgaagaaaagaaacaagatagggcaacagctagaggagaattcaggtgagaggtttctactttcaaatgagaagggcttatacatcctaaagtaaggggtgggaacagaaggagggagaaggaattgggagctgggggaagagtggtcctaaagcctccctagatgaatttaattatttgggggaaggttactagtgaccaattgttgacatatatataagccccatttcatacatgccatgaataataggcctccctggggtaacaaaaatttaaagatcattctggaaaatgagacaggaattaaaagaactctatggcttgctttctttatctacctggttctggcaatgtgagaataggttttctgaagaggagccaatagtttgtttttccacttgtgggttacaatggtaaaatgattgttggcaaaagaacatcttttcaagcagcttcccttggtgtaggtcagaggggcaacaagcagagttatttctgcagctgggaaaaaggttcagagctatcttcctagaatcggctcttgtttcagaatctaaaatagatttgaaatattgtgctatttgggaattggggcctattcatgctaagcacatctgtgggtagctgttgaaattcaaataaattcaaataaagtccaagtaatgctcatactacacttaccaatttcaaattttaaaaatacatatatacaatacctgcaccccatttggtatcactacctaagacacaatatggaaagccttgattttctgccagccatagctgctttgaacctgaaccacaacatttaattcctttgaaaatgccccttcctccctacctgaacttttcaactgagattcattttcaaaagtttaaatatgaactatagcaaatagttctatattttggttttgatcatttgacagactttagtagctgcaatgaggttgttggactacttaagtcataaagccaggattgaataaatgcattttccttctcgtcatctttctgatttcagtaaatacagtttacttaggtgtggtgattaaggaaacctggtcgatttatttatacactattccattccatattcaaggtgtcttttaaaaggcaaagtaagggaacttgcctttttaaatttaaccatgactttcttatagtgatctacccaatgtatggaaagaagtagaactggctgggtgcagtgactgacacctgtaatcccagcaagttgggaggctgagacaggaagatcacttgagcccaggagttcgaaaccagcctgggcaacatagtgagacccagtctctaccaaaaaaaaaaaaaaaaaaaaattagctgggaatggtggcatgcgtctggagtcccagctacttgggaggctgaggtgggaggatgcttgagcccaggaggttaaggctgcagtgagccgtgttggcagcactgcactccagcctggagcaagacccctttctcaaacaaacaattattttaaggttgtgagtttttcttttttttccttaatagttaaaaatttgaaaggcatttaagtgacatattcatgtcataacctgagagtttacaatgttataagtaggtaacacattaagcacattatatgaattatctcttaatttaaacctcataattacccaatgaagtttgtgtcatcatttccatcttacttataaatgtatccaaggcttacaaataagtaatttgtccaaggtcacacactcagccaggagtgaaactgtgcccattattcaaattattaactgttttgatttttattattatttgtagagacaggggctcactatgttgcccaggctagtcttgaattcttggccttaagcgattattccaggtcagcctcccaaagtgctgggattacaggcatgagccactgtgcccagcctgagctgttaactcttaatctaaacaatgccttttacatgagaaacagtaaacaagatggcaagggatggcaaagaggatactgaaatatgttaggagctacatacaagaaataaattcacagttaaaagatgaagacctttatctaaatccaggcaaactgcaaactttaaaaagaattatgataagaataaagcatcaggaaggagaaagacaaactgatgacactgatatcccagaataaggccccatagacaaaggtataaccatcatcacatatggttggtgactcccacagcgtgttcctcaccttccccagtgcctttgggaaatgtgagtgttctctgtaaaagttctggcatggtgaaagatcgtaactctaggaagctgaataacttaccatttggcactaatatccctgatttcttctgtttaacttttttgctctcatctctatgttgaaaaatgcaatagatgttaaaatcagtaataatgttcaataactagtacagctgttcccttgttccacctcaattttatttatagaaaagccattattccactattctatatcaataacaattttcatttgtttttctacgtgtataatatgaattatattaaataacaaattttccagtttccataataataattctaatgactatataacagtctgttgagttgatgcactgtaatttatactgggtattttgtttccagttttttgctattataaatatccttccaagaatttatttaggcatctaatttacttaaatttcttcatatgcaaatagtatgtttatgtcctctgaccatttatctcttgaggttttaatatttttgaagatttggataagtccttaatttgttatgtatactaacttcttccctgtttcctaattatgtttcccttcttgtgtgtttcaatcattgttagtttttttatgttaaaatcactttttcttgatgtttttaagctatttttttgtgtgatttccattgttgccataagcttttcaaaaatgctgtctaaagatttcacagatatttgatgcatatttctcctagtttgctaaaaattaaaggatatagttaactctttaatgcactatgatcttactctgctatgtaccataagtgctaatttaaattactttttgtttttgtgttttttagccagttatcctggcaattattaaaacataattagccagacatggtggcacacatctgtagtcccacctgtttgggaggctgaagtgggaagatcatttgagctcagtagacgaggctacagtgagccatgatcacacaactacactccagcctgggtgacaaagcgagatatgtctcaaaattttaaaaataaagataaaaaataaaaatgaatacaatgaataaaatgtaattactaacttattttttcctaattttatgatagtatatgttgaatttatttctacatgtcttacactgctttattcaattagtgtaataacttatactttaggttttaggatttcctggggaaattctggagactagagcagcatcataagtcacactttctttgttagtgtggaatttcaatatttaacaaacagtaaataacttcacttggtgaacattgtttttctgtataatatatatctaaatctgtttatcttgttttgtatagtccattaaagctttgtacttttctttacatatggcacatacaattctttatcattttctttataaatgtcatggtttgaaaccacgtttgcagagatgataaaagtgagagactgaggcaagatgcttcttgcctcacaggtggtgctccttgctcattccagggcataggccaagctcactatggaagaaatttagtttatagtttgactttgaaccaaggatgataatagtccctccctaagactgatcccctccttgtccgggactgaagccacctttgtaaaactaatgaaaggccacaagattagtattatgggaggagcctcaattctgctcaaatgtaggcatagtttctataatcccttactgctcagtactcatgtggccagaggtcacaagatttaagacttccccaattgcgcccatagataacatcactattgtagaacctacgattgggtttttgagatgttttttcacttttgttttctggcaactgactgaccatatccaaccagtgactcatgactcaaccagtgtgtcctgtggccccccacccaaaggaggactcagcacactgggatcattttccatacccctgtgatttcatcccaaatcaatcatcggcacccattccctatccctctgtgcaccaaattatccatacaaaccctagccccttatcagagagactgatttgagtgataaccccagtccttctgcttggcagccttgcattaattaaactctttaactgcaataccaggacctcagtaaagtggttttttctgtgtcccctccacccttttttgtggctatgttaaatgggatttcttctctttttgttaaactagtggttaccacaataaagaaatcccctaattatagtgaattcactataaacctagtcactttgataaactcacataggctaataagcaaatttcttaggatttttagacatgcattgctttctgcaaataatcatagttttctctcaccccttaatgtatcattctgttgtcacgaagtgaatgcagttgccattattcctgtattagagtgctaggctggaaaggcaagaaacatacatgttactttcagttcctcaactgaggaagccattgatgaagcaccttcttttcatggatcaagcaccatgctaaacacttcatatcgaccatcttgcccaaggctgagaacaagcctaccaagtatacaattattaaatatcagtgttgaggaaactgaagtttagcagatgcaggctgcccatgttaggccccaagaagcaataaaaaatggaacactgaggggcctaactatgggggtctgtgaatgaaaggctgtgagtctgtgtctctgggctcctgtgactggcaggtttatctctacccaggagctgcattgaccatgaactttggccagtgatctatgaggaactagggagggatctcagagctgaatccgctcgcctgcatctgtgtcttgtgcatatgcttcacacttcctgtttctaggtcatagtaagtctaatgtgaaagtaatcctgaaggtagtctatgttcttgttttcactgctctccaacccatcagccctttgaggttaatttatctcagatcttagaaatagcaaacgatggagtaagtggcttccttcacgaccagtggtctttccattgtaccaatgatgtcctcatccaaatgtaagtcagataagatgatccaattttgacaggctgactgttcctgaatatgcattatacaaattctcacagaggctatactgtccacatccttgagttgcttatattgctttgcacataacaagtattcaataaatatttgttgatgcagaatgaatgaatgaatgaggcaaagacaacagtcttaatgcttttcctacaagagagactttcaatgatagaatacaaactcatgtggtatctcctaaaaatctcaccatttcacatttcaaatgtggaagcttctataaagactgtatttgtcatgagccttttcacaagaagatgtttagtaccaggtcagcttgttttcatcttgttttcaaagaattggggttaggaaagcaggaaactaggaaggatcaaggtgggaacagtggtaggcaggcttttctctgacaaagttgtttgggttatttttatctttctgcttctgttacagcaacaatatgagaaaactgactgttcaaatttaataaatagagtctgtccaaacccaattttgaacaaatgacaaactatggtgcacatgcattaacatttctgtttgggtatgcaatgggaaactaagtcttatgttctcgtctgtaatttaaacatacaaagttttaaatgttccattagaagatatactacaatactagtacattaattgagtgttctttgttatgccaaaaaattccaaaggaagttacacagcccctagaaggcatagaatctgtagattttgtaattatggtttttaaacttaaaatctcattgaagtcattagttaacatttctaaactttttgtttgtttttgttttagacagattctggctctgttgccaggctggagtgcagtgggacagtctcacctcactacaacctctgcctcctggattcaagcaattctcctgcctcagcctcccgattagctaagattacaggtgcccaccactacgcccatctaattttttatatttttagtagagatggcatttcaccatgtttgccaggctggtcgtgaactcctgacctcaggtgattcacctgcctcgacctgccagtgttgggattacaggcatgagccctcgcacctggccacatttctaaacttttatgcctgaataattctgaacagatattccaataaccttcctgccctccacctcatcccagccaaagccgggagagagggaagacctatactaccaatagttacaaacaattatttttggaattaaaaacaggaatttgcaccatgaacaagtgtctcgttttgtcttctgagcttctcaaaaaccaccattatattgagactataaaattgttctttaggctgggcaagatggcttatgcctgttgtattagtctgttttcacaccgctgataaagacatacctgagactgagcaatttacaaaagaaagaggtttataatggacttacagtttcacgtggctggggaagcctcataattatggtggaaggcaaggaggagcagtcacatcttacatggatggcagcaggcaagaaaagagagcttgtgcagtaaaactcccccttataataaccatcagatctcgtgagacttaccattgcaagaacagggcaggaaagacctgcccctataattcaatcacctcccaccaggttcctcctatgacacatgagagttgtggagatgagatttggtaggggacacagccaaaccatatcaactgtaatcccagcactttgggaggctgaggtgggaggattgcttgagcccagaggtttaagaccagcctgggcaacatagtgagcccatttctacaaaataaaataaaaaattaaccaggtacggtggtgcacacctgtggtcccagctagtgggaggatcacttgagcctgaaaggccaaggctgcagtgagccatggtcacaccactgccctcaggctgggtgacagagcaagactccatctcaaaaaaaaaaaaaaaaaaaaaaaaaaaagttctctgaaactaaaagaaaaatctagggaaattaaacattttttattgcaaatcacttaaccttagaatgtcaaagattttccctaagtttttatataaaaagaagcatgggagagagccatagggaatcaaaatttatgagccacaatatttgcaagaagagaaaacattacatcagccatgcacggtttctccaacatggatacaaagcagaatgatgtaatagcagctgcagttttgtgctaccacattaaacagtggtgcttttgatatcatttaactaaaccaaaatatgcagttcaacctcacatagctcaaaatactcagttcaacctgagatggtcctgaattaactagaccatgtttcaggcttctgaatattatttttaagttctgtgtaaggtaaggtataaaagaagaaaaaaaacctccttgcctcaataactttggttttaataaatgcaccaataaatttatttgaaccctgagttaaaatgattcagctctagtggatgaccaaattgaggctgcttttctttatttattcaagttagatttcatgtaaacccttaaattgtatgaattcaactatcatttctaaagcagccagactaatatgaacctaaatctgagtatacttttccagaaacagctgactatttaggtctcgttatctgtcctgtatctcactatcttcttcccaaccacaggaaactgaggattggctactgactatttgaaattggctatttcatagaggtaaaaatctcatcagtatgctggcaacagtctttaattttgaaagaggaatagtcccacttgactatttctagcttccagtattaggtcaggagagaaaacatttctttagaaccttttccataaaatcagggaataatttaggaatggggaaatcttctagtgttttatttcagctctcctagggatgtgcttcccaaggctttgacagggagaaactgatagctatcagtgtgaatcagctttgtgtctaacaatttcctttctaaggaacatcaagcatagagaaatgattaagcatatttatataatctaacatattaagtgaattacatttaggtgaaattggaaagtcagcacgtattgctttataatgaacatccaagccctgcttgatttgcctaatggactatttgataagggcaaaatacattctgatttaatggaatttctaattagttaatatttagtcaaagtgcaacattaagcgtatccctaattatatgtatgataggagtttacaaagcaattggtatgggttttatatttatatttatatgtcatatatctttttctgaaaaaaagttgaaactagaacttaaatagcttacatgtttatcctttctatccttgttaggaaaaattcctttaaagagattacaattattactgtaccccgataatcattattatccttgtgcttaattttcatt

SEQ ID NO: 1791 - DNA, 9930 bp, Homo sapiens
ccagggggtattttggaaaacagtaggagcacttttctattatcacatgtgattttctttattcagtctagtaaaagttgaggtatacaatgttataaaaaaagaaaaggatgttgggtgtgagggtgttgagaatcactggatctatattatatgcaagttgctgaaaaaaaaaacaaaacactagttctgtgtacttggaaaatgcttacatctggtgggacaaatagaccccactgtgtagcagccaagtctggataaagcccttttaaagttatcacttgggtcctgataggcttgataagggacctatcagatgggtcagataaagggccatctattcccaaaggcctaagaatgcttgacatttaaaagctacacgcaattcctgctctcagagagcccacagctgaggaagagactgagacaggtaaacaaatttcaaatctgtggccacatttacttaaatgatctgagacacttatagagtactaggagagttgaaaaagtcaactgcttttaaaacttaagacatgtcattgaggtgctgagccctggcgatcttccacactgcatcgtggatcttaatcagctttgttatagatggcctgagccaggttagatgaggatgcaaatcaaaaagcagggacaatgagtataatgtggcccttccttttcccagtattactagctcattgctacactctttgcaggtgtggcccactttctttgagagaccccttgtgaggaaagcctttgagaagaccctcaaggacctgaagctgagctatctggacgtctatcttattcactggccacagggattcaaggtttgagtgactccctttctcagcctctagtttctgagctgttgcaggaattcagggacccccaacagagagactggctgaagccatggcagaagaacataaattgtgaagatttcatggacatttcttaattccccacattaatgtttttataatttcttacgcctgtctttactgcaatctctgaacataaattgtgaagatttcatgaacatttatcacttccccaatcagtacttttgtgatttcctatgcctgtctttacttaaatctcttaatcccatcatcttcgtaagctgaggatgaatgtcgcctcaggaccctgtgatgattgcattaactgcacaaattgtttgtagagcatgtgtgtttgaacaatatcaaatatgggcaccttaagaacaggataacagcgatgttcagggaacaagggagataaccttaaagtctggctgcctgtgggccgggcagcacagagccatatttctcttctttcaaaagaaaataggagaaatattgctgaattctttttctcagcaaggaacaaccctgagaaagagaatgcgctcctaggggtaggcctctaaaatggctgctctggggacggctgtcttttacagttgtagataagggatgaaataagccccggactcctgttgtgctcccaggcttattaggacgaggaaattcccacctaataaattttggtcagaccgattgtgtgctctcaaaccctgtctcctgataagacgttatcaatgacaatgcatgcccgaaacttcattagcaattttaattttgccccggtcctgtgatcttgccctgcctccatttgccttgtgatattttattaccttgtgaagtaggtcatctctgtgatccacaccctatttgtatactccctccccttttgaaaatcactaataaaaacttgctggttttgtagcttgagggcatcatggaacctgccgaaacgtgatgtctcccccggacacccagctttaaaaatttctctctttgtaatctttccctttatttctcagaccagccaacacttagggaaatagaaaagaacctacatgaaataacgatgaattatcaggggcggattcacccaatactgagcaggtgccagaaagtagtagctgcaccagggctgcagagtggtgtggactggagcaggagagcttgcacttcataattgggaatggcaggtggtcaggaagagaccttggagcagaaagatgctggctggaagggaggctaaggccatgtgcgctgctgaggtgctcacatgcctgggttatcttgcagttatgtctgagagaagacatgatttctggcagcccagacaagttgtaactgccatatcacctttgtctagattccatgccctggggttgccctcccaggaaacctcttgggttattcttccataactgtattccagggcttaattattttattaagcaaagcacacctggcagtggcatcttggagaaaagtccaagtatggtgatgctggaaggaagccagtagtgatcccagcacccattgcctggggctctgctcttacctgctcctgaggggtgggggagacaaatttccagctctctcccctcctgaccagctggagtgatgatggcctgccatcccgaattccacgcctcttctagaggctgcaaggatagaagttggccaatatcttctccagaaaaccacaccctggagatctaatctttatccagtgatactgaaatgaaagtttgcccttgggtgtgtataggatgtaggtgtgtgaggttaatgtccatggtgataatggtggcttctggaatgtactaacagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaatgttgatttttatttatttttttcatgataaaactttcatatttccatggtgtatggaactataattttttatgtgtttctttacgtgtaaggtgagagtggcaagaacataaaatctttacctgttagttttagattttcttgggctggggaggggcagtagggctggaaccaatcactgatgggcacccaggccctggactgaaatttcctgtgaatgcttcagctaactctgttgcggtggatcctttagcaatttctgccccagggaagactaaggcaagccagggtccctgtagtccctctagagctgcccataaggtattcctttctatgataggccatggaggagctggtggacgaggggctggtgaaagcccttggggtctcaaatttcaaccacttccagatcgagaggctcttgaacaaacctggactgaaatataaaccagtgactaaccaggtaaattctattcagtttaagggtaagggtcctgccctattacttcttaaacattgcggggggaatgttcaatgctatgccctgagtcttatctcaggggtcagtgatcaggacactttggggaggtgtgaggctgatctcatgggtgatttagcaagaatctcagtgcgcacttgtttggcctttgcttggtggactttttttgtgtgtagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttggtgaggcttccaagtggtgggtctttctcttgataatcttaaaaacattattttataattggtaaatgtcggtatgggtccataagttactggaaagaaaaatgtgtgtaaggtaacacgtttggtacacacaaatgggatggcagtgggaaaaaatgggaattaaacaacaacaacaacaacaagggcgacatgcttgaccctctgggaatatttccagttcagccacccaagggtgaaccaggcttgcaaaatgctgaggcttcagagcccggggaaaggacccaagcttccaggtcctcctgcctgtctcccagatggagaggctctgatgatcagtcttgagaccctcattggagtggtgtccttctgtacacggtagccatggtgattattcacatcagcatctttctgcccctagggccaaacctgaggacccttccctgctggaggatcccaagattaaggagattgctgcaaagcacaaaaaaaccacagcccaggtaccatatttttatttttcttgttatccaaccactcatgcttccagtctcatgtttcatttctcgtgttgtcctcaactgactccttaaaggggaagaacacaggagctgaagccctctaaagtatttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtccttgtagctgagtggaaacatgatgtcccctttctgcacaggttctgatccgtttccatatccagaggaatgtgacagtgatccccaagtctatgacaccagcacacattgttgagaacattcaggtaagtttccggctggtcgggcctggtattcctcagtggagtgggggacaggcagaccttctcactaggcttctcacctcatccctgcactgtctttggccccctccttccccaccaccctatcattttccagcccagggagctaggctcggtagagctgagatgaatgacccatgggctaagaacatcctgggggcagtgcctggtaaagccctatcaggtctgagcacagttgtgcctcacaccactgagaagaccctcagttgcccctgagcagctaggccctaggccatacacaagagcagactgtcctggcctacctgctcacctcccagcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccttggacagaatgggaaaaactcctatggccagtttgtgctgtgaatgtgagctccctccctgctagaatggccggcagtctccagccacagcagtaacagccttaccgataatgtattggaattctttcctttctaggtctttgactttaaattgagtgatgaggagatggcaaccatactcagcttcaacagaaactggagggcctttgacttcaaggagtaagtggcatggagttaactagaagaattgccaggagtttttctaaactggtagagggttagttggaaggattagaaggttgttgggactacttgtgtcttcaaatactattttggggcagttttgaaagttaaaatttgggtacctgggaatcactgtaagggacacatctctaattgctgcttattgtctgaacttctggatgtagagctagaattgtaagagaaggtgtgttatcaataggcaggaggcagaacattcatttattcattcattcagtcaatatctagtggtcatctgtgtgccaggcattttctaggtgcttgggttatcatactgtacaaagctgctgcctccacaggcttagggagggagggaagaagagacaacagaaataaatcaactcaaaatattgatgtcagacagcaacaaatgctagacagaaaagtaaagtagggcaaagtggacaggaagtggtaggtggtagtgggactgatcctttatacgggttgggtcaagggaagctttgctgtgagggatatgccatatgtatatttgggggaagagcattcttggcagtgataacagcaggtgcaaagtccctgaggtgggattgtgtttagagcattcaagcaagaaggccagggaggctggattaaatcatctccaaatgcctcttaaaggaggtggtgctaactttactttaaatctcagataagttgttgaaaaaaagtctttcactctggctaggcgggaattctacatcatctctttagaatcaatactttctgattaatgtgtctaattacatatatcaaatagaattgtctggcatttattac

SEQ ID NO: 1792 - DNA, 3706 bp, Homo sapiens
cagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaat

SEQ ID NO: 1793 - DNA, 65642 bp, Homo sapiens
ctttctacttgcatgcatcctttgcttacctcatattttgaaggatacctggcttcaaagacagtcgtcagggatacagcacccaggcatctggtcccctaggtcaagctcccttgctggcctccttcctaaccctgaagcagggcagagaaagaaagaaaggcaaggacttcatcagggcctggctgctcctatgaatgagccatctctgtcacaggcacacactctctctctctcacacacacacacacacacacacactcacaccaccactatcaggtaccttctgccgtgaggagcagcagccatactccaaagcataaatgccaggtgggcagcagggaggccgaacacctgctcctctcacctctagtgcatcaggccctcgacctacgtggccttgttccatgttcgcatccggcctgtgaggtaggactgacgaatcctgactcagaggaggaagcaggcccttagaaagtgttgagagaccagagtcacacagcacccagtgttcccaagcctgacaccaggtccacgattcttccaccatcacacagagggagtgcggcacagttcaggccatgggagcaagccctgccctttggggagaccggtgagcagcccctggggtgacagccccgtcgttttctggggccagcccctgtgctgtgggtgggggtctcctttccatcccctgctcaggtagaagacggccttccttgcctggttatctcagcaagcagggctggccgacagtcagccatcacagcctccccatgttaagacaaatgacagttgggagccccaggtccccatgcagatgggattttccacagagcccacactggatctggacttgggctttgcacaacagtaaagtatagaaatggaataaccacaactgtacgtgtggagatttctggtgattatccacctgtcttagttcggatggaatttagggttagggaagaactcttttttttttttttttttttttttgagaaggagtttcactcttgtcacccaggctggaatgcagtggcacgatctcggctcactgcaacctccgcctcccaggtataagcaattctcttgcctcagcctcctgagtagctgggactacaggaatgcaccccctgcccagctaatttttttgtatttttagtagagacagggtttcaccttgttggctgggctggcctcgaactcctgacctccggtgatctatccgccttggcctcccaaagtgctgggattacaggcgtgagccaccaagcccagcctagagaagaactcttgtgttgcaaatgtcttctttgtggatagtgagccaacagagaatcacagttagctaaatagacaactaaccagaaacatatgatgtaaaatactcaagccaagaaaccacatctcttacgtaaaaccaaagtgaaaatagagtgcgcaacagtcctaaaagactgttttaggatgagtattattatactaataatactagtgataataggagctattctgtgctaatttccacaagtattaaattattcattcgcacgacaacactgtggggtggctagaggatgaggaggttgaggtgccgcgcatcagtgcacagtgtgaagatggggttagatgatgcctccatcagcagcaggacttggagccctgctgaagctccatctcccaaggtaaaggcatgcccagttgcaaaagggagaaaaagcaggttccatgaggcctcatgtacaagttggaggagaaagtggctacacagagtgggactagaaaggggagaggggggccgggcgcggtggctcacgcctgtaatcccagcactttgggaggccgaggcgggtggatcatgaggtcaggagatcgagaccatcctggctaacaaggtgaaaccccgtctctactaaaaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagaaaggggagaggggctgtgtgagttcctgctgaagaggtcggaggtgctgtctggatgctgttagggtcattttatatctacacatgagcggtgctcagcctcaccagggctttagatgtcatggccttggaaggagacgtctctgcgggaaggaaataaaatggaaagcctgtgtcttattgattagaatggtgatgccccaaacacactggtctgttaagacatttgaaacagtttacggcaaattggaaaatgttttataaagttttatataaagatgaatgtatttaatttaaaagattatcctttgtagccaccatgattaagggcagggactctggagcctgctagcctgggctcaaatcccagctcagccaccagatagccacctattgctcagtgaccctgagtgaagcattgaacctctgtgcctcagtttcctcctttgtaaaagggaataataatagtacccatggccttaaagttgttttgagaataaataagtcgatgtggacagcacttagaacagtgcctggcacgtggtacataccataaaagtgtttcatattatccctatgttttaaatgtaaaaagccttatcttggccaggtacagtggctcacacctgtaatcacagcactttgggagatcgaagaaggcagattgcttgagcccaggagttcaagaccagcctgggcaatataccaagaccttatctctacaaaaaaaacaaaaaacgaaattagctgggcatggtggcacatacctgtagtcccagctacttgggaggctgaggtgggaggattgcttgagcctgggaggtcgaggctgcagtgagctgtgatcgtgccactgcactccagcctggggcacagagtgggaccccgtctcaaaaaaaaaaaaaaaaaaatttaagagagaaagagagaaagaaaaagaaaaggcctatattttagaaagtgatagagctgggaggttttctgtttggtttggtttttgttggttggttggttttctcaatgtctttacttgatcattaaaaaaagcagcagcagcagctggtaaccctatttgccctatacttctttttgtactcatctttgatacccagaagtctaagaaatactgatttgtaaagaactgttttacccaaaattgtagcacttttctttgcaacttattttctcccaaacactccagcttcctgagattcctcttgagtgcttagaagagtacctggcttatcagaagggctagataagagttagtccttttattcttgtatatcgattttttttgcatatcttattaggatggatctagaagtagaattgctgggtcaagagcattcctattaaaatggagactcctgtgactcggctgtcttcctgaaacattatacgtggaagtgtccacttcctcacaccccgccattttctatgacatccaagcaggaaaactgggtggacaatgaggtgaggaggtgcagaaattcctgtcgcctcctcccctcctgagctcagaatagtttgggtctgaaagacggctgctccccacagggaggtagaggaggtgagatgcagaggctcgcagccccctaactctcacgggcaccctgggagatcttgttcaaggcacaagatttcacacgctgacggccacaactagcctgcctaaagcagccagttttgcttgaaagatgagctccacttatccagagtgggtgccccactctgggctggggccaagtctagagctcttcgtcttacttggccacagaaagaaaaagggcggaacatgctgaggatgccattgtgcctcttcctcctttacatttaatggaccagtagagaagaaggaatgcgtttcacctttctgtaagtaacacgctcagttcattccttcccagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtgagtgcggcggcagggccctgcccatcacctggtgggcacagagatgaggcaggcgccttgaggacctgtgacctagcccagtggccatggcatccacgtgaagcatgtaaaggagaacatgataagcaggatgggaacaaggagaggatgctgtgtgacagcaccaagcagggtgggatggcctccagagaggcaagctcagggaagactttatggaaggagttaaatttcaaactgggccttaagtgactgcatttgaggggagataggggaaagtatccagggcccagggaacagcacaggccaatcacagaggcagaacggcgtggggcacattgggtgctgccagcaggtgagatggcactgtcacagaaacagggttcaagggctggactggaggtcatgagatggaggtcttgaacatctgggtgaggagccaggtttcatcctgcagtcagtagagagcactgagggctgtgccactagagtgagctgggcagtcgcagggctggggaagactttatggaaggagttaaatttctttaacttctttaaatgtctttggcggcagcagggagaggagagatgcacatctccataggaagcagctgcccttgctcaggcaaaagggatgggaattttttcagggtgatgggaatgggaaggagagatcagggcaagagacttcatagaggtagagtttggtaagatttagaacctatcagagaaggataatgtttaaaaatgattaagcttcccatttaacgactaggaagagagtgatgccagtgatgcagacaaagtgtcaggaaggaaggaaccttagaaatgcaacaggaggaggacccaatgggggtgcctgcggtgttgtcaaaggggacagtgtgtcctgttgtcagcaccagggctggcggaatggtgccccatcaggaccacagaatgacaaattcaaggaaacagaagtgtatggttgacgatccggctcattaaacaccatggaagtcctcaccaatacagatgcagtctgtggaatgtgtgtttctaaaggctattggagttggcaaatcagataaagcatataaatgagatggtgatgctttaggcatccaataacccacagtaccgggtattctacacgggatcgatgcccacttgcgtttgatttctcaaagcctgctccattgacatttgcaaagcagtgggccaggctgaaaataaattggatgtgaaagctgatcacacaatcttggaggtcccaccagacacaagagtcccttccacctcagcctatgagaggctgatgccttctgagaaaaggatggctcggccccattcctgctggcctttctcttgggcttatcttgatctagcactgaactttgtgcccctccgctgaacccccttgttccttcacatgctgttttctctgctgaaaatggccttcccacctccaccctcccttttttccctagaaatcatctttgcccctctcaagcttcacctcacatgtgacctccttggggaagtctctcctaatcctccaggcagctgaaatgtgtctctgccctgagatgtaccctatgcttgatccctttaactctgtgccccgctaaacttcagaagtcgagactgtgtattgccctagaacttggcaatatagcaagatatatttctagaacacagagcctaatgagctcacagtgaattatatttggatgaaatatgtctttcctaaaaaaatgcattatggagttgaagaaattaaacaattctggcttattctaatgtattggtaaaacagcagaggaccaaggtgtatgagcatgttctcctcttattttttttcgtttcctattctagtttcactgactcactaattcatctgtattacaggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggtgggagttattttcctgactcaagaagttctttctttatgtcgtgttcctttctaataatggttttcatagcagatggtcagtatttaggtgtcttcaagtaaatatcataattcctattttatttctagtttcactgtgctaaggttactgaaactgtcccacaaaaagaaaatgattgtgtctatgtggaatgaaccacataaacagtaaatgcaatgagaagaatctcctagtgccttgaagtgaccatatctcgccctagtccatggtagatactaaaaggctttattggctgggcgcagtggctcatgcctgaaatcccagcactttgggaagctgaggcaggcggatcatctgaggtcaggagttccagaccagccatggccaacatggtgaaaccccgtttctactaaaaatacaaaaaaattagccagatgtggtggcacacacctgtaatcccagctactcgggaggctgaggcaggagaatctcttgaatccaggaggcagaggttgcagtgagccgagatcacaccattgcactccagcttgggcaacaagagtgaaactctgtctcaaaaaaaaaaaaaaaaaaagaaagaaagaaaagaaaagaaaaaaagaaagaaaaaaggctttattactcagtcttgaggctcagcccccataatccatgttcatcattactaggttaatattaagactgttgaagtaacatggggctacccccaagtagacactcaccagccctttcacaaataaagtggcatcaaaggggaagggcttcctttcatgtcagaggaggaagcgtatgaagcttaggagcaagggtagacccaatgggattagtgtttcctccaaagacagttgtctcgtagatccagagctgccactgtaatcaccaaccacgttctcccagggcactacagagtaggtattactgaaccatccccactttggccaaccgagttcttcattacccgtgggccttctcgttgtctttgctctaggttattatggttactggtgatcatcccatcacagccaaagctattgccaagagtgtggggatcatttcagccaacagtgaaacagtggaagacattgcacatcgcctcaacattgctgtggagcaagttaacaaacggtaagcacaggagcagcatagtaaaaattccagtttatacccatggggccccactggctctaaagagctgcactacttggaacaaatcagctttttgctctcagagttatgctaggcttgtttgagctattatttgcatatccatgtattcactctaatttcactgagcagctaatatgtgccaggcacagtattgataccatgaaatgaccctttatgtgttccttgtttgaaatttcaaaatccagtgtgccctgggcacaaaacctatgtgcccaatttagaataagaaaaactgaaacaaagggtttatgtgaaattacttgccatagatgcagttgcataatttggaatcgtaagaaccctgtgggttgtttcatgcaccctccttggtaagcatcttgggtatttatccacccggtttcataacgtgtagctatgtaaacacacccttcttttttatttggtaatagatagaatggaagcttcctaaggaaagtttttttccttgtttctcctaattcttttaatcatgtttatccttattcttttaatcatgttcatccaactgtacattcactcatgtatttgttctttcaacaagtatttactgcgtgccaactatataccaggcaagacctggaactacagtagcaaactgaacaatactatccacaccgttggggaatctttccatcgagccaaggagacacaaacaaagctaacaatgatgtggccagtgtaatgagggagccacacaaggctagggagctgggcatgcaggagagtggcctggactgtgcctggtctccatgagtcaaagactccgaattctcaggttgagaagtaatgttcattagctgggttatgttttcacgcatgcgggagatgagggaaagaccaatgcacctcttcagtttccccaagcacttaggtcttttagggacacacagctgtcaggtcataacaaattaccacgttagacaaccaaccagggttcccgcctctgggcacagcagcagtacctgaagtctaagagtcttgcagtgccctttagtatacataacatccctctatgaaaacaactttggggcttgtttatttgtttggttttgtaagataatcggattatactttttttcactttagaattttaaacaaattttgtttgtttgtttgtttgtttatttagacagagtctctctctgtcacccacgctgtaatgcagtggtgtgatctcagctcactgcaatctccacctcctgggttcaagcgattctcctgcctcagcctcctgaatagctgggattacaggcgcccgccaccatgcctggctaattttgtatttttagtagagacggggctttgccatgttggccaggctggtctcaaactcctgacctcaagtgatccacccaccttagcctcccaaagtgctgggcttacaggcgtgagccaccacacctggactaaaagaaatttttttaagagtagtcaagtgcagtagtgagaagaggggaaagagtagaagtttgatctgtaactgactgtgaacaatcagttgagctaattcactactaccttcagaccagccgagtcttctttttttagatacaaggtgtcctgtcagatcacccaggctggagtgcaatggtgtgatcatagctcactgcagcctcgacctcctgggttcaagggatcctcccctctcagcctcccaagtagctgggactacaggcttgtgtcactgcacccagcttcattttagcagatttttttttttttgagatggagtctttctctgttgcctaggctggagtgtggagtgcagtggtgaaatctcattgcagcctccacctcctgggttcaagggatcctcccctctcagcctcccaagtagctgggactttaatttaaaattttagcagatttttttttttttgagatggagtctttctctgttgcctaggctggagtgtggagtgcagtggtgaaatctcattgcagcctccacctcctgggttcaagcaattctcctgcctcagcctcctgagtagctggggttacaggcatgtgccaccacacccggctagtttttgtacttttagtagagacggggtttcacgatgttggccaggctggtctttaactcctgactgcaagggttctgctcgccttggcttcccagagtgtagagattacaggcgtaagccactgcgcctggcccattttagcaatttttaatgaaagttgtatataagataccttattcctgcatcttctcaattgcttcttttttatatttgcccttccttccctacttaggaagatttgtttggccttccattcaaggatcttttgtggtctttgtctagttttagcctggtgatggccatgtgctggtgacgtgcacacgacggtcctgcccttagcctcctcctgtgctcctgttcagtataggtggcacatttcttcctataaacctggactgctttgccaatttgctggcccgtatagtgtctttgtgcaacctcaacttcctcatcctttcagatgggcatggatggaactgtgcttgtagcagactccagaatgtgcttctgtctcagctctttggaacgagagaaagacataatcttcctacgaatgtgggaaggtgcattgaaatgacttttatgattcttgcctcagtcaaaagtcacaaagggactgcacttcctcttggtcactgccactctgctcatggccacaaaagggaagagtggattacacatttgtatacaaatcaccacactgagtgaagtggatgcttttgtgaatgttttcagttattcacttcatcagctctagtttcatgaccatataaaaattgcatcttagcaggtgtaaggggaaaggaaacaccccttctttcttctcttactttcttttgttttgttttgttttgtttttttgccagcggttaaggagacctgtagtttgagtcaagtgctagaattccagtatttagcaccaagaggtaaaacagacctagaaagctcaaaacttgcaaattgtaaagaaaaagacctgcagcagtttgtacctacattgtttaagctgagatttgaaggctgaaatgtagtgttagccacgagaagctgaggtgagagatgcccattcctggtcagggagcgagacccgtgaaggccttagggtacaggggatggaggatgtcagaactgagagcatccagcgggcaggagggagagcccaaggtgaggcgaagcttgacaacgcaggccccacctgggctcgctggctaaagttagggattccggggtctgctccaagcacggtggaaagcccctgaagagttttagcaggggactggctcaggcagctctgcataatcaataggccctagaaccttacttttatagtcagcaggcaatagcgctgctcaaagacttcagtaaacttctgcctacgtagcacattgcacaaagatgacactctgtaaatctgaaatacccaacggcaagtaattattaccccttgtttggccataaaagaattctaggacccaaaacatatgaacaggcagtttgggggttttatttttatttttgtttttgagacagggtctcactttgtcacccaggcttgagtgtagtggcatgatcatggctcactgcagcctcaaccccccaggctcaagcaatcctcctgcctcagcctgctgagtagctgggaccacaggcacatgccaccatacctggctaattttttaaaattttttgtagagacaggggctctcactatgttgcccaggctggtcttgaactcttggcctcaagtgatcctcctactcagcctcccacagtgctgggattacaggcatgagccactgcgtttggccatgaatgggcagttttttaacttccttttacttctgaagtaaagcgttgctctaggaagtaccactctcacctgttctagtagggataaggctacctggttttttattcctattgttatatggtaccaagaaatggtgttatattttagcctcagtttgccctcttgaaatggagactaaagtgttcccaggactcctgttacctcactagagcattaggtatcaaggacactgggttccaggtcaagtcagagaggcttcagccagcatcctgcctggaacagtgtttcaacctaagatctgcccttgggcctcacccagtttcttctggcccttctagggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggtgggtggacagcagtgtccagaggactgacaggcccatcactgtccatgggcaagtgcagaggtctggatctcacatcaggctgtggtgcctttgaaacttcaagagagagttcttggctcatccccatcacctgacctctccaacctctcaggtgggctggcccctgtcctcctttgagacccccaccacatgttccccgaaaggctcaccccagctctctgcattttgtcatgagagcccggtgaagcatttgccactgtggtagttgtgagtaaagagagatttaaaatgcaaagatttaaaacaaaaaatgtgaagacataagatacaagacacctgcgcattaggttttcctcatttgcacgtatcttgtttggagacccttgttcctgcttctaagatttctcatctttatcttttcccctaaatgggcctttccgttcagctataatcatcctcgcaacctcaagagaaagggaagtcttgttgctcttgccaggcctgcaacccactgggcctgctcactcccactttctccctgggtcccccgccataggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtgagtgagtctcagggggtcttcccaagggccagggtggtctgggggactagaagtaagttctgaaggagaaacctctctgcctaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattgtaagtgacactgaagggaacaggctgtgatgcctgccccaggggaggtcaagttcagggtcgctaccttcaagggccggggatggactaactcaaggcttctcagcttccatgtgatggggcctgtagctctgcatttctcacaggttctcaggtggtgcccattctaccagtccacatgccacacctcaaagcaagggaccagaggcatctgccaaatgtttggaaattaaaaacactctatagtgagcttttttttcttgagacagagtttcactcccatcacctaggctagagtgcagtggtgctatcttgcctcactgcaacctccgcctcccaggctcaagtgattcttccacctcagcctcccaagtagttgggactacaggcttgtgccaccacacctggctaatttttgtatttttagtagagatggggtttcctggcctcaagtgatccacctgcctcggcctcccaaagtgctgggattacaggcatgagtcactgcacctgagctatagcaagcttttcaagacatgagtcttcatcctcaaaaaaaaaaaagaaatgccattggtcagtttcagcctatgggcttcccttttcttttgggaagatgaagctgtcactcagattaatcacccaaataaccactgggggcccagtgactaaagtgataatctcacagccacctcttgttaagtaagagagtctgacatggaagacctttacctaaacacagtaagaagtagcagttatgaagactttataaagccttgccctacagtaatgtcacctaaaccttccccttttccagtatccatttaaagaaagccccgtctaagctgcccatgtggctgtggcttacgtgggcaagcagggaaagcaacagacagcaagctgaattcttagcaggaaactggcccttcgaagtgcccccttccccttcaaattgcccccttcccctctcttgttttctacaacacccaggtaatccctaattcctagagagactggagatgtctttccctttgaggggtattgaggtccccaaagttgatggatcattttccaagcccttcacatttgcctgctttgctctgctgcagtgcttctccaggcctggtgcgggcatcacctgggaacttgttagacatgcacactctgggcactggtggacacctgtagcctagctactcaggaggccaatgcaggaggattacttcagctcaggagtttgagtccagcctggtcaacacagagagacctagtctcttaaaaaataaaaattaagaacaaataaaataaaaatcttattccagataactgggctaggaatggaaataggttgtacacccattgtcttttaaaaaagagaaagaaagaaagagaaagagagaaagaaagagagaaagagagagagggaaagagagaaagagaaagagagagaaagagaaagaaagaaaggaaagaaagaaagaaagaaagaaagaaagaaagaaagaaagaaagaaagaaagaaagaaagaaggaaagagaaagagaaatgaatgcaaattctctggccccagcccagtcctcctgaattgggaagtctggaggtggggcgcaatgatctgtctcttagcaggtcctcccacctggagggagaggacggcacaagaaattctccctgtaggggaagagtgttttataaccagcatccttcagaactgccagcacagggtgataaaaagcagctgatttctaaaggcactattcttaaatttccatacagacaacacgccctctactgcctatagcctggatgggccagctccatgccccccaccccatccagccagtgccccacccaccccagcccccctcccctactgtgggtagagcagaacatcctggggttagacctcaccagcctcttcccctctagatcccctccattgccttggcgtacgagaaagctgaaagtgacatcatgaacaggaagcctcgccacaagaataaggacaggctggtgaaccagccgctcgctgtgtactcatacctgcacattggtacgatgagggcgcgtcttccccatcacacgagggcctgccccgagaattcactggagtggggggcacagccagaaagtgtggttttcctgtggggcctgggttggggagggagggggaaccgagagtagacaggatgaggcagtttcctgaggccatcatagaacctgtgtcctatctctcttgttctttcaggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatgggtgagtggcgggagccctgctgcagagtccacctgattctctccatgctcattgccctgcgcagaattacatagaacctccatgtccctgaacagcctgggaaagcttcaattaatagggctcagggcccccttgctgacacgtgtttggcctttgccaggtctcatggcacagcctcctgtcttgggctagatgacaagaggtccctttttttaccttagctttgccattggtatagaagagtgaccagcccagccacacccacagtgcggccaaataaatttacatctttcaggccgggtgcagtggctaatgcctataatcccagcactttgggaggctgaggagggagaatcacttgagcccaggagtttgagaccagcctggccaacacagtgagaccctgcctgtgttagaaataatagtaatgataattttttaaaaaattaacatttttctctactcagctggttcaagaaagaaaaatgtttctttccaaacactagaaggtggtccattctcagtccgggtgaggtgtggaaagaacatgaagctttagagaactgcattggaatttcctagaagttttcctttaggcctcaaggtctcttccttctctgcccattaacagacaaggtaccagagggaatacctagaatggacgggctacacggctttctttgttggcatcctagtccagcaaatagcagatctgatcatcaggaaaacccggaggaattccatcttccagcagggtctcttcaggtactgcctgtgcccggcctcctggggcagccctgggcctgccgtgcaaggatgatgatgatttgtttttcacaagacagagttctggccacacttgtaaccccagaggcattgatttttctggtggcatggtctgctgggtgtatgatcatgaagccacaagaatcccaagtctgtctgcttttgtgtgtcttgcagaaataaagtcatctgggtggggatcacctcacagatcatcattggtctgatcctctcctatggcctcggaagtgtcacagccttgagtttcaccatgcttaggtgagttcaccctcaacagcatggaggaaagagccagcctctgctttgagctgtcgcagcctaaataaacctgaggattcccagggttcttccccaagtctttcaaaagacgtcaaactgatcccatgctctgtgagcccaaagctttgatctgcattttccagaagtggaaatgggttttctagacctcaccaaccggccttcatcctcatccaacaggttgcttcaaaggcagacattgcttctagcagtcacagtgcaggttaaacaaggagctttccacctttattttgtgggacctcgtggatttgtcgttctttgcagtaaagcaagacaaatgaacgagaagccccattcccattgggcagggttgggctatccctgtggatgagtcagggttcactttccatccctttgcttccagggctcagtactggtttgtggctgtgccgcacgccatcctgatctgggtgtatgatgaggtgcggaagctcttcatcaggctctaccctggaagtgagtagcctatgattttagaggctctgtttacccacttcaacagactctccatttctgatgtacttttttctacctctacaggctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtatagggaagaatgtgtttatgtgtatttgaaactccttgatgttaatagtcttgtgtaacccaggcatctactggggcctgccttaagctctagctaggattgctcagaactcctttccacaccctattaaaggccccatgacctccctaagatttctgcagatcccctgagaaggtatgttttcatggtctccttgctcgaaaaaggccaactcacccgagggtctgcaggagatggaagtggcggcaggtttacatcacagcagcacgcatgacctcagctttgactcgtttaactctgagacgtccttcttgaaggcccttgccacagtttccctggccacgccaccccatcccacctctggtcatctccccagccctttatgccccgtcgccctccacccctacatcagctcctccaaaactgagctcccagttcattttgcatatcctaactcaaaatgctcagctaatccaaggggactttctttaccaggattcaaccctagtagagagctgttatggtttcaatagtcatatttatttcttgtaaaacagttgccaggtgctctccagcaataacgttttgtcagtcatgtttcatgttttaacttaggtgtattcatgtgtgacacttccatgttgacaggcccggaaaggcctcatttttaactaaaagatgttttataaacccaggtttaattgtggtgttctaattggttcacatttttctagaatgaagagcatgggacaaaaaaataagatatgatttcctattttcttttcgttgctccttctggtcattttacttatctgtggaagatctggaaatgtaggatttttctttcaaactcttcctcatgaccccagggctccagccagggcctctgatgtgccctcgattcttggtcggacgcctgtgggagggcccgtctttctgcagcagcactcgagagaagggttctacagcctttccatcaactgcacacctcgcactaactcatttgacagaacgtgagaattatgtttggttaagctttcctcatctagtggcctgccccgtcacctctctccattacagtctcactcgggggcatctggggctgatggctctaggttggcatctcctggacaggaaaaggcagccttagagtcaccatgctcttggggtcacatgtaggagcaggaaagagggaaggagactatccttgtaactttatgtatatagattccagtgcatattgtgtgcagccatgtaagctaaaataatgttgctgtcctcaggagatttgtaatctgtgttcagccacaattatcattggactaatctatcagtagttccagtgaactgcaaacacttcccagagtggtttgggcagtgtggtcatggctttctcgttccagtctcgacaaggcagctaatgctttctagacttcagctaagaataacttgaccttacttaatctttcttgacaggctgcctgagtgctcatggctgcaatgcttggcagctcttggtcctgccaatgccagcaggacaaggccatcaatttagcacaaagctgcaaggtttaacttggggttggattagggttgaaaggagttaacttggaattagaagcctcttcatagcaggaactatgtatgaaataacgttcctatttgtgcttatttactcttgcaaaaagttgacactcaaatatttataaaattaacaaataactaacttaagaaatcccagaaaagacactagcattattgagtagctttattaagttgtagacagaaaaaggcaataaaatccatttcagagggtgtttttggagggactatttaattgaccctctgaagcctagatgtcttttattataggaaaaaaaaatgtcaatttaaatctaattgatgtggtagagtatctcagagacataaacatgaggctgaattcctagagtctttgctttttaaaacaatctaatttattctgattataaaattgcagctctaaatgagctattttcttaaatagaaaatttagaataaatgagattaaaaagtaaattaaaatcaccctgaatctcactatgtagtcatatacctaaatgaaagagtaatcatttctttggagtttttccacacatatatttatttttaggtaaaattaaataaagttttcaattctgccttttttatttaacatcaaaaacatggtgttaatgactgcacagtattgtagattgagagtgctttcgctaactatatctgcacggtgagatagctcattaatttcctactaggcatctttctcaaaaaggctgcatcttatcctcaatattgtaccacacatctccattttatagaagattcctcaaattggaatcaaggcattcagagcattcctaaggctctggccacacattgcctaatttatctttagataagctgtatcagtttacacccccaccagcaatagaaaaagaatatttatcttgcctatcattaagatgtgaatgctcagtcaaccaaagagctttccataattcgacaaagatgtaggaagtgctcctgcatggcttgagaacacagcccagaacaagatagagcatggagccagtacaccagtagaggggtgaaaggaaaatacaaattgtgataaggtcttgaaaaggcataatggggcttagataatcaggtggcaggattgagggcagtcagctaagtccttttaaatagggtagtcagaaaagtcctttttgttgttgttgttgagacgaagtctcacactctcgcccaggctggagtgcagtggcacaatctcagctcactgcaacctccgcctcctggattcaagtgattctccagcctcggcctccccagtagctgggactacaggcacccaccaccacgctgggctaatttttgtatttttagtagagatggggtttcaccatgttagccaggctgctcttgaactcctgacctcaggtgatccatctacctcggcctctcaaagtgctgagattataggcgtgagccaccatgcccggcctagcaaagtcctttttgaggagatgaatgcaaagaagcagacagaatgacaggaagagggaacagcatgagcaaaagctctgagaggtcagaggggcctagcaggaacacacagccagggaagaccttggaacggggaactggagggacaggcaagaatctcaccctagaggggttcagagaccaaatgaaggaggttgcatttaatttcaaaacaagctattaggcccagtgcagtggctcacacctttaatctcagcactttgggaggctgaggcaggagaatcacttgagaccaggagtttgagaccagcctgggcaacgtagggagaccccatctctacaaaaacgaataaacaagctattgaagacaattaataaaagaggtgacctgatccagttgacatgttcagatcactttggcttctgtgtagaggatgggaggcagaccaggctgtggtaactggtgtgtgtaccttcaatggaatacacagactcaatggaggagtttcttaaggggggttgcctctaggtgactcgagacataaatgttcaactcaggctcctagaaaggctcacaaccaccctgactgcccacatcacaatcaagatagagacaggagatgctcaagcaggtgtcatctcgccaggagtctagaacaagatatatgtctcaatgtacacggctgcactccttaagagcctggacaggtgcatctgactctacaaagatcatgagttctccacatttgttcattctgctatcatcattccactggtggcatctaatgtctcttaaaaagacagtggctggctgggcgtggtgactcacgcctgtaatcccaacactgggaggccgaggcggtcggatcacaaggtcaggagatcgagaccatcccagctaacacaatgataccctgtaactactaaaaatacaaaaaattagccgggcgcggtggcggacacctgtagtcccagctactcaggaggctgaggcaggagaatggcatgaacccaggaggcggaggttgcagtgagccgagatcacgccactgcactccagcctgggtgaaagagcaagactccatctgaaaaaaaaaaaaaaaaaaaaaaaagacagcggcaatcactgatatttgttaagtatctattatgttctgggttcctaacagcatgatcttattaacgctcacaacggccccgtcagctgtggcatcagccgtgctttacactcaggaagttaagcctagaggcccagtgacttcctggcactgtgacctctcctgaccactaagaggctccactgtagaatctggcaagtggtttagggagagtttgcccttcgatggaatatagatgcctctagagcatagcctgcaggtgttgagttctgtcttacagctctgcaggttactgataactgagagcaacagaaagtatttctatagatatgcaaatgaatcctacccagtgggtgaagatctttcctccttggaaaagccagttttgctccctttgcacaatcagccaacattcctgattccagataaaagcgtgcctctttgctcctctcagtagattttaacaactgcctagtttcctatttaagtggtgagctttaaaaaaaaatctttaatatgtgttcactgttatatctgtatgaaaaaattatccttacaccatgaacagaggaagaagaacacaattccctcctcatttagggtccttctcagcccctccgtggagctaggcacccagcccgtccgagatcctgaacccccgcacgctccagggccattctgctattgggcagggatgccgtttttttctgcttcagaccagttctctcagcaagctccttcttccccgtccccattcctactttcccaccctcccctctgacataccagaaccaagcttgggggattttatcttcttggtccagaggttctaagataaagttaactggaaatttaaggtaaaagcctgattaattttaaagggatagaagctgccctcctcagacttgctgtgcaggtagatagagattcggtggagtgaagcacttcaatgcaagagtttatttgtagtttgggggatttctttttttctaatttttttttttttttttacattttctatttacacaaagggatttcttccactccacccgcacccgccgcctctgctttcaatcttttttcttttcttttcttttctttttttttttttttgagacagggtctcactcagtcatccaggctggggtgctagagtgagtgcaatggtgtgatctcagctgcaacctctgcctcccgggctcaagcctcagcctcttgagtagctgggactacaggtgcactccatcacgcccagctaatttttgtattttttgtaaaaaagggggtttggctatactgcccaggctggtcttgaacccctgggctcaagtgatccacccaccttggcctcccaaagtgctgggactacaggtgtgaaccaccacacccaaccactttcgttgtttcaaatttagcacctgctaggtacacagcacagtgcagaacaatgctgtgctggtctgagaggacaaaatgacgcaatagggaagaccaggcatgtttgcaaataaactgtcaatcggggcaggatttggccgaggccttgagaggtatacagtgctgtgggtttccagggagaccatctttggtgggcaacagtggagggtgccaggaggcaaggcatccaactcagccttgaggagtagggttccaattgcagaggtgaagcagaggaaagggcaggggccaaagatgtgcccaggttggtcacagccatgtccctgtgagccagctccctccaggacaaagtcaatgtggtgcagagaccccatgacctgggtctagcattccacttggtattcctaggggggctgcagtatccattgaccaaatccctacagacagaaataagattgcctgtgggagaagaactctaatcagcccagcaagggctacattagagatctgcagaaagccaccttacacaggagccaggatgctaaaggctgtccatcagaaaggggcttatgtagccatagaaaaagatgtccttcccagcaacacggatgcaggtgaaactattaccttaagcaaattaatgcaaaaacagaaaatcaaatactgcatgctctcacaagtagcagctaaacactgggtacccacgaacacaaagatgagagcaacagacactggagactccaaaaggggggtggagggagggaggaagggaggcaggtattgaacaactacctactgagcagtatgtttaccccttgggggacaggatcattagaaacccaaacttcagcaccacaaaatagatccaagtaacaaacctgcacatctgaacctaaaataaaaataaaaaataaatttaaaaaaagaagaaaagggcccatctgtagcagagaccaagaaaagggtcaggccctgaggcccgttggtgtgtccccaaacccttggcacgggaggggcctggtcaggctgaggcatgaggatggcatcccaggcaggcctgggcttaatttgggaaccgggtgtcaggacgcaaagccacatctgctgactcttaactccgcactggcctgccaaccttctgacttgtgacccaacccggggaagaggccggctgggggatgtgaagacccctagccctgggcaatgtcaccgagactgtatgaatgcacctagtcgtggtggaatcagcctctgtgagccatcaacgccccggaggccacggccccggcagaccccggcatgggaaggcagggctggtgcgggcctgcagcgcggctgtgagggcacgagggcgcagggggtgagtcaggaccacgttcccgggcagcggaggacacaaagcgccagctcctggggggcttgtgaggattgaacaagcgtggacgcgttgagtgccttggaagagtcccggggccccccaagaggctcggaaggtgttcgcagcgtcctcacattggcgctccccgccgcatcgcgcgcctctgaccctgcacgcgggcttggagcctgcccctaggacctcagcagcctctgcaacggcctccgcatgctgcttgcttgctgggaatgcttctgccaacgtcctcagttcttcccccaccttcccagacctgcccaccctactaacaccccggtaccctccccccacactccctgccccctccaccttcgcttttcagcacaattttctcagcctctgacaccccatattttcacggctttcttattgccacctcccgacctacaagccctggacgctagctccaggaggatgggacctcgcctcctggagtccccactggagccacaggagtgcctggcactcaggatcgctcagtgaatgtttgatgaaggatcctgggggagtggaacagattgtcaacaagggaacgagtcaagaaaagaggcttagaaccgtggaaagacctgcactcagaaggcaggaggagccccggggtgatggcccgtgcctgtaatcccagcaatttgggaggccaaggcgggaggattgcatgagctcaggagtttgagatggactctggcaacatcgcgagattccatctctacaaaaaatttaaaaattagctgagtgtggtggcccacgcctgtactcccagctacctgggagactgaggcagagggattgcttgagcccaggagttcaaggaggcagtgagctatgattgtgccactgtactccagcctgagtgacagagcaagactctgtctacaaaataagaaaagaggaagaagaagcagaaggaggaggagggggaggaggaggaggaaaagaaaaagaaagaaagaagaaagaaagaaagaaagaaagaaagaaagaaagaaagaaagaaagaaagaaagaaagaaaacagatgtattcaactgctagacttagggatagtgtcctctagttcttttatattcttcatggaactgagtctagttttagacaaataaaaagctctcaatactcatccaaaaaacaaattagcaagcaagctgagctcaggctgggggcgggttatgtccaacgggtacattagtaaaaggtcactaatggccattatagtttgtagtttgagctcagagagaagtgatctctgtcccctgcattctcaaacttcattggcaaagtagggtccccagctgcacctgctcccctgtccttgggatctgacttctttcttcactgtggctactctcactaggtccagcggcccttcttcagtcctcgtggtgcttggcctctcagcagcattttacgccatgtcctagaaattcctctctctatggtttcccaggttctgcaccctcactgggtaggcagagagtgggccatgttgatatgacattgccaaacacctgtgacacttcactggaagtcagagtagcatcaggaaaagctagccctggagtgagaccacttgggttttgtcagagccaccaaccaagactaccaggaacacacctgtggtcagagttaggtttaattaacttgtgcttcaatggagagagtgcaccaagaaaaccatggggttctgggtaagatggcattgtgagggacgtatgataggatttggtttgtgctgggagatcctgaggagggtctcaggaagcaagagccagggatggattgggtgccattgggaagtgagggcaaacttgggggtcgggcgaaggaggacagagctgtcatgttttctcaggggaaacttgcctcctctaaccaccacccattgaacctgcttctacaaaggcaggtctagcaaattgctttaatcttcagacactaaaacccaatgctggggctatcttaaggatggctgcatcccagtatgtgtcctgtttgtctctaaaaagctgtattttaccaccaaaaatggaagatttagggcaacaggacaaatttgtgtcatctttcccttgtgattagactagagtctccagaagctagcagtcattccatttatattatacattagttcatctagctccttcataagcagtaattggccttttcacatattgcattattagagagaaaccattgtagccactctgtagaaacagaatagactccacccaaaatttggttcagatgccaagactgttgatgccacacacacacaccaagaaggtgttaaaaggtttactactcacataatgaaactttctcccaaggtggttcccaagcaactccaaaaatggcttggccaagcgcggtggctcacgcctgtaatcccagcactttgggaggctgaggtgggtggatcacgaggtcaggagattgagaccatcctggctaacacagtgaaaccctgtctctactaaaaaaatacaaaaaaattagccaggtgtggtggtgggtgcctgtagtcccagctacccgggaggctgaggcaggagaatggtgtgaacccgggaggtggagcttgcagtgagccaagatcttgccactgcactccagcctgggtgacagagcaagactccatctaaaaaaatggcttgagagagcagggagagaagactggcatgcagtttttaaagaggtgtctgaaagagagaacatccaggccttctgatcagcttgccaagatgtggggcaattcacaggtgaggagaatgaatctcagaaagggaaagaaaggagtgatgcttaaaagctattagcagcagacatcaaaaaaatggagtcaggctgggcatggtggctctcacctgtaatcctagcactttgggaggctgaggcaggtagatcactggaggccaggagttcgagaccagcctggacaacatagtgaaaccccatctctaataaaaatagcaaaaaattagcccggcctagtggcatgcgtgtgtaatcccagctactcaggtggctaaggcacaagaattgcttgaacttgagaggcggaagttgcagtaagccgagatcacgccactgcactccagcctaggcaatggagtcggactctgtctaaaaaaagaaaaaaaaaaaattgggtcagactctattacacagggcatgtctgaattcagtctgctcagtgggagaagagaacaagtgtaaagaaactatggtacaggttacagagcccctgtggcatgcccagaatcatgctaggcactcactgcagggccttccatggtgcttattatttgccagacactcttcaaagcactttgatacaggttaactcattgaattctcataataaccttaagaggtgggtactatacagtcagccctccgaatccatgcattaaaccaactggggattgaaagtatttggaaaaaaatatggatggccggtggcagtggctcatgcctgtaatcccagcactttgggatgcccagacgggcggatcacttgaggtcaggagtttgagaccagcctagccaacatggtgaaaccctgtctctactaaaactcaaaaattagctgggcatgctggcaggcacctataatgccagctacttgggaggctgaggcaggagaatcacttgaactcaggaggcggaggctatggtgagccgagataatgccgctgcactccagcctgcgacagagtgagactccatctcaggaaaaaaaaaaaggatggtttgcttctgtactgaatatatagactatttttccttgtcattattgcttaaacaatacagtacaacaacaatttacatagcatttacattgtatgagttatgagtaatctagaggttatttaacatatatgggaggatgtgtgtaggttatatacaaatacaccattttacatcagagacttaagcatcagtggattttggtatccaaggggaatactagaaccaattccccacgaatactgagggacaactatattatcaacctgtcttgcagattagaaaactgcaatgcagagaggctaagttgcccaggcatgcaaaattagctttaagcagcaaagtcaggaatcaagcctgatcagcctgactccaaagtctgtgcttttagtcattgtgtgacaccatttctcataaacagcagcttaactaatgcctgggaaatccaaaaatatttagttgagtctcttctacttgaagagctcgcattccccaagaatactttccatagtgaaagtattgcattattatattgtattatattaatacagctatatattaacataaaaaataaaacctcaaaagcatttgaatggtcttacacaattttcaaaatttcgtttagttttacagcatcactggaaattaaatgaggtggcaggtttatgactacaactccatttgtaaaatgcaggaaaaccaaggctccaagcagtcagccctggatccctccatggcccctctttgcttcatctgcaagctctggcgggaagtagtggttccacccaagagcagagctggtgaaattgtggcttgatggcagcccgcttcccgtggctccctgtccactgtggatgctgctgcagcctggcacgtgcttcgggacgcagagtccagggagcaggctgccactgtcaccgtggctctggtcatcattgccagtgtgtgccacctgccacggccgcagactctgtccacacattagtagctctgggaacatgggaggtcaaatgtcaattaagagcaacacgcatacttcacactcgttcgcaacagatgtttgcaaagccctttcaagttgatcctcataaccaaccttagaaatgatctgggcagttcacaggggaagagaatgagttcctgagagaacaatttgcctaaagtcgctcagatagtcagtgactgactcacgcctacctgcctcccttcatgactccagtgcacacctcacttaaagtctttaaaggtggagagactaaaccagaggctgagcaagctgggaatcaggagctcctgttcttgttcctgtgttcaccagatccctccgtggggcaggtgctggtgggcaccattatcatccccatcctgggcaggttgtccaggtgggcaccattatcatccccattttgcagatgaggaaacagaggctcagagaggacacaacttgccccaaggtcacatagctcataggtgtccatatagtccagtttgctggacctgagccttcctactacactgccccgccctgtggtggaggcccatttcccttcttctcctcctcctgaacaagatcctgggtaggagagtctcccagctataatagctctttgtcaaaagacagaatttgaatgaatttgaagatcttaattggctttgtgattctagaatcaggcaacgctccattctgtaaaataggataagtgttccaataaactgagcagaaggagttggttttatagacaaaaaagggtagaagaaagcagaaacaaacaagaaaaggagtattgatcctttcaaagttactttccttgtaaggtggaaacaggaaaacagaacaatagaaaggtaactgattagttaacatcaagttatttcaggttacttttttctttttttttattgagacagagtcttgctctgttgcccaggctggagtgcagtggcacaatctcggcttcacagcagcctccacctcctgggttcaagcaattctcctgcctcagcctcccgagtggctgggactacagatgcccgccaccatgccagctaatttttgtatttttagtagagacggggtttcaccatgttggccaggctggtcttgaactcctgacctcaggtgatccacccacctcggcctcccaaaaggctgggattacaggcgtgagccactatgcctggcctatttcaggttactttttgttgtgcagattaaaggcagagggaactttattatcatgttgactgaaactggcctatttggggatattatctctatctcctgatttctccaagagtcagatgatttggtttggtgacatggaactttagtatgagtgactccatcttggcttctggtctggtgagctggagcccagtgcaggatcttagtccaaaataatgacctcataatttttataacatccttatcctggagctaaaaaaacaaaactgcagctcttgtattcgttgctaccaactgcttcttatagcatgaaagacagaaaaagcagttggattacatcattcccctgtgtgataaaggacaatgtttcatcacacctgccacgctctgccagccctgcctttgcccaccttcccagcatcactgggtatcactctcttccttatccaccagcttccagacccaccaccaactggaagagggtcaatattacattaaaggggagcacatagggtgacatcggatggtggccgtctttaggaacatgcaattagcctcaaaaacaagactaacccaggtgaaacagttaaagaccagtaaaagagcatgcataattgtgtgccaggatggagggtgctgataaggacagggatctgaagagcaggtggtgctggtgagtggggaagtctgaaggaggcactggggatttggaagcagcttaaggtgtcagtacagtggtgaacttcgacaattaaagtactgtttcactaaaacaggtaggctcatgtatgtggaataagtattttcagaaatacttgtcaattcagatgggagttttacttgcctgtatgatgaaagaagaggaagtggggagaaataagaagagaagctctgagaggggaaagaaggctcagaattgcattccccttgtgagcgtgctgtgtctcagggtgcccactccactgggctgccattcttttcttctttttccttttctttttttttgagatggagtctctgtcgccaggctgaagtacagtggcacgatctcggctcactgaaacctccacctcctgggttgaagcaattctcctgcctcagcctccccagtagctgggattacaggcacgtgccaccacactcggctaattttaaaaatatttttagtagagacggggtttcaccatgtcagccaggatgatctcgatctcttgacctcatgatctggctgccattcttccacaatctcaaattccccttaccccattaggcttcaacaggccctcatttgtttcttcatcttctctctgaagccattgttgaaatggatccatctgcattggaatcgtaaccagggttggtgaactgcatggaatgcacatccaactagagaatgagagagtaggaaggcatgcaggacagaaagtggtagccaaaaactgctgtgatgagcccatgagagctgagacgggactttgcttcgggatctattcaacttcttattctattatgacgctggaaggagggatggagagtcttcccaccacagaggaggccagatcagagtttggccatgcaggaggagcagctgcaggtgtgtggacccccacaactccaccccagccaggtgcctgtggtagctcccaggaaacgccctggggccggcacccagcagccagtggcgggcaccatcagtgactaacatggatccattctgtggccatctaaaacaacaggctgcattttgctcttaaaagtcagcccctcccagctactggggaggctgaagcaggaggatcacttgaacccaggagctggaggccagcctgggcaacatagggagatttagactcaaaaaaaaaagaaaaaaagaaagaaaagtcgatcccaaacttgcttcccttggccagcctcacaatagagtagacgcagggcatgggctaggactggtgcccttctgaggtttcctaagcataataacttgcctcagtgcaaacaaacgcaatccctggaaacatagatattgtttcacagtgtctacagcttcatgtttttggaaggagaaaccctgatgctcgcagcagtgaatgtatgccagggaatggaaggaactagagaaatgcacgtgaaacaccgaggagtcagaagatgcagcctcaactctgtaaggcaaggcaagctctctctcaatgcaggatgcagtccaggcacatccagcaccaggacagctgtaaaaggacactggcctgggctccatctccaacctcctgaatcagaacctccagggctggaacatctgcagcctctccaagaaagagatttttaagctggaggtgtctgagctctctacctgtcgcccacatcctgcttggtcaggagagcagtcctccaccctgacaggcagatggagaaggcctctgatgaatggatggaggaagggtcagtgagggctagtgttggagtcctgaaggagtgagggagaggacagtgggtgggtcctaatgctctgccccccacgtagggaggctcacagggcacatgtcctcaggctctgcaggtcacctacccaacttttagttataatgtcccagagcttaatatggggctatttctcaagaaaaaatagtagcccctgtcttgtcccctaactcctcatagcagcaagtttgaagtttgctgatctacaaaaggtcctcaaatctggcctgaagcagcaatagtatctctccatttatccaaaaattcatgtttgtgtagtccttctctgttgtaattcccaaagcaagagtttttaagtgcaggagcatgtctgaaaatcaggacccccagggctcttgctcaatcccaagaaggttagagtggttcttagcttcagctgtcccatcctaaacgaggaggtgggattctggaatttctaaaagtcattcctactccactgccctataatttctaagaaaaaagccagccacttcgtcatagagttgggtattccacctcctctgaaacatgtatggagaacagcttgaaccttttcactgctcacctctgcttttagtgactaaggatagaaaggtcagaggcaaagtggcaaaggacttgaaaactaccttcaaaaactaactgcaaaaaccaaactactaatatcgtttggtggctgggcgcggtggctcacgcctgcaatcccaccactgtgggaggccgaggcgggcgaattgcctgagctcaggagtttgaaaccagcctgtgcaacacggtgaaacctcgtctctaataaaatacaaaaaattagctgggcttggcagagtgcacctgtagtcccggatactcaggaggctgagacaggagaactgcttgaacctgggaggtggagtttgccgtgagccaagatcgcgccactgcactccagcctggcaacagagactttgtctcaaaaaaaaaaaaaaaaaaaaaatggtttggtgtgggtctggcgccctctggtgtgttttgagactgtgtcatgctggctggtgctaagttctccctgctgccatctgtggtctgacatgtgagcacatgctgtatatgctgagagtgctgtattataaattattattattattgttattattttgagacggagtttcgttcttgttgcccaggctggagtgcaatggcacgatcttggctcactgcaacctccacctcccgggttcaagcgattatcccttctcagcctcccgagtggctgggattacaggtgcccgccaccacacccgactaattttttgtatattttttttttagtatagatggtgtttcaccatgttggccaggtttgtctcaaactctagacctcaggtgatccactcgcctcggcctcccaaatgctgtgatcacaggcatgagccaccacacccagactataaattattttaattaccacctgatactttcagtaaatctagaagaaaaatggtaaatgcaaggttttattaaaacaaaaacaggctcaaagttaaaatatacttgagcctttattaaaaaccacaataaaatggccaggcgcggtggctcacgcctataatcccagcactttgggaggccgaggtggacggatcacaagatcaggagatcgagaccatcctggctaacatggtgaaaccccgtctctattaaaaatacaaaaaaattagccaggcatggtggcgggcgcctgtagtcccagctactctggaggctgaggcaggagaatggcgtgaacctgggaggcagaggtggcagtgagccgagattgcgccactgcactccagcctgggtgacagagcgagactccatctcaaaaaaaaaaaaaaaaaaaaacaacccaataaaatgccatcatagaatatctatgcttgtctgtctgtctgtctctctctctccctccatgttttgagatggcactacagcaatgtgtaaaaggtaaatcaaggttcatgaccctgtctgtatcaattagtgggctcttgagttttctattgcacccaacagcaccccactcctgcaaaaatactaacaacaacaaagctgaattttaaacaggaaaagaaggcaacaaagcttatggaagagaacaaatatggaagatatttatggaataaacatggaatggaatacaaaacaaattatggaaaataaatacaatgaatcagaaaggatttctcaaaccatacttgaaaatcgtaaatcttaatgaaaataccatagaaaaataaaacatctttcgacaataagagatataaacaaagttaaaaagcaagtcatagcctggaagagtatatttgcaatgggatctaaaataaataaataatagctacaaaactgtaagagacaacccaaaaggcaagtaataatacaaaagcctaaattaccaataaacatgaaaaagatgttaggttccttagtcattagagaaatgcaaactaaagccacaaggagctctcatagtgccttcaatgagttagcaaaaataagacaaaaaaaaaaaaacaaaaaaacagctgtcaagtgtttttctaagtattttcataaaagattcatatactgcaggtgggagtgaacagggaggctaaaaagcaaaaaagttttctatcttgtatacatttgagtgcagaaaaaacccagaaaactcccctgataatctaagcacacctgccctcgggtgggcttaggattcaatataatgatcttcaagtagtccaggaaaatacaagccaagaaattatagtagccctagactcacagtgccttggagcaccttaacaaaacaaaaacaaaatctggagaaatgtacccttaatacaggcctcacagtattcccacaagtcaaccctttcaaacatgagtttataatctaaaattacaaaatacattaaagagaaaattaattaactgaaatatatatttgaaaaaattattcagaatgcagcacagagagagaaagaaatggaaaatataaaacagaggttaacagaaacaaagtgtagagtgagaaggtccaatttactgcctaatagcagttctagaagaaaatgacaaggaagaggtaaaatttaaagagacaaatgactaacaatttcccagaccaataagacaagaatgctcaaatccaagaattataatcaatcccaagcagggtaaatgaatatctacaccttaatattataatgaatgtatataataccaaagaaaaataataacttacctatatggaaagacaatttgactgtaagaaaatttctcgatagcagtaatagaagtcagaaatcaataaaattatattttcaaatttagaaaaacaaaaaaaaacctgtcagcctagacttttatattactaaacaattactcgagaatgagggtgagataaaaatacatttttatccaattaaaaactgacatcattcaccaatagcataccctcagctaaaggcacttcttcagaatgtccttgaagaacaaaaattactgtagaaagaagatatgaaacacaaggaagaataaagaatcggccaacacgtgaataaatctagatttattaataaaactaggttatttattaaattggttggaaggtacatgggcacagatacttctttattcttttttgtgtggctaaaatatttgatagtatttttttaagtagcacagggaaaagagttctaggcagaagattctgaggctagaaagagcttgacctacttatacaactgaaagagagctagcatatctggaacagggtaaagagaagtggtacaaaatgagggtggaagggagtaggcaagagacatgaatagacactttccaaaagaagacatgcatgtggctaacaagtatatgaaaaaatgctcaacatcactaaccattagagaaatgcaaatcaaaaccacaatgagacaccatctcactccagacagaatgactattattaaatagtcaaaaaattgcagatgctgttgaggttctgggaaaaaagggaacacttgtgggaatgtaaattagttcaactactattattgggggaagctgcccccaatatttcaacgtaggttctttctattttccgtaagtgtcggccggctgagaaataaagagagacagtacaaagagaggaattttacagctgggccaccaggggtgacatcacctatcagtaggaccatgatgcctgcctgagtctcagaccagcaagtttttattaagggtttcaaaaggggagggggtgtaagaacagggagtaggtacaaagatcacatgcttcaaaaggcaaaaagcagaactgctagtaagggtctaacaaagatcacatgcttctgagggaacaggacaaagggcaaaagcagaactactgataagggtctatgttcagcagtgcacatattgtcttgataaacatcttaaataacagaaaacagggttcgagagcagagaaacagtgtgaccacaaatttaccagggcagagtttttccccaccctagtaagcctgagggtactgcaggagaccagggcatatctcagtccttatctcaactgcataagacagacattcccagagcagccatttatagacctcccgcgaggaatgcattcctttcccagggtgttaatattaatattccttgctaggaaaagaatttagcaatatctctcctatttgcacgtcagtttataggctctctgcaataagaaaaatatggctctttttacctgaccccgcaggcagtcagaccttatggttgtctttccttgttccctaaaaatcactgttattctgttctttctcaaggtgcactgatttcctattgttcaaacacacatgttttacaatcaatttgtacagttaacaaaattatcacagtggtcctgaggtgatgtacaaccttagtttacaaagataacaggattaagagattaaaataaagacaggcataagaaattatgaaagtattatttgggaactgataaatgtccatgaaatcttcacaatttatgatcctctgctgtggctccagccggtcctgccgtttggggtccatgacttcctgcaacacattatggaagacagtgtggcaattcctcaaagacccaaagacagaaataccattcaacccagcaatcccattgggtatctacccaaaggaatataaatcattctattatgagcacacatgcacatgtatgttcaatctagtactattcacaatagcaaagacatagaatcaacctaaatgcccatcaatgatagagtggataaagaaaatgcagtatatatacaccatggaatactatgcagccataaaaaaagaatgagatcgtgtcctttccagggacatggatggagctggaagccattatccttagcaaactaacataggaacagaaaaccaaataccgcatgttcttacttataagtgggagctaaatgatgagaacacatggacacatagaggggaacaacatacactcggacctagtggagggtggaggtgcattgagggagagggttaggcaaaatattatatgtattttgtataacagacccccatgacatacatttacctacgtaacaaacctgcacatgtacccctgaacttaaaataaaagtaaaacaaacaaacaaacaaaatgttcatcactaggaaaacagatgaacaaactgtagagcattcatgcaacagaagactcttcaaccacagaaaggaacaaactactgaagaacacaccatagacgaatctcctaaacttgctacatgagacaagctggacaccaaataatacatattgtgtgatttcaggcaaaatgaacctatggtgaaaaaagtcagaataaaaataacccctggggaaagaaaaatttgcctgggaaggaatatgagaaaattcctggggataatggaattattctattctttttttgagatggagtctcgctctgtagcccgggctggagtacagtggcatgatctcggctcactgcaagctctgcctcccgggttcacgccattctcctgcctcagcctcccgagtagctgggattacaggcgcccgcccccacgcccagctaatttttcgtatttttagtagagacgttgtttcatcatgttagccaggatggtctcgatctcctgacctcatgatccacccaccttggcctcccaaagtgctaggattacaggcgtgagcccccgcgcccagccaaaattattctattcttagtgcaatggcaaaatttcagctcactgcaacctctgtctcctgggttcaagcaattctcctgcctcagcctcctgagtagctgagattataggcacccgccactacaagtggccaatttttgtatttttagtagagacggaattttgccatgttggtcaggctggtctcgaactccggacttcaggtgatccacccactttggcctcccaaagtgctgaggttacaggcatgagccaccgtgccctgcctaattattctattcttaaaatgggtgaaggttatatgggtgtatttaattgtcaaaaatatacagttaatttttgtgcctatgaatatgtgtacatttgagctcattttttaaaaaaaagaactaaaagaaatgatgggatggaaaatgggttgaagtatagatgaaataaaaaaggcacatgaatagtagtttttgaggctgggtgacgggtctattatactattttgtctactttgtgtttaaaattttctataataaaacactggtctaaaaagacaagttatctacaatgttcttaaaattttggttatcttttcaggggagggcaagaaaaagtgattttcaggcatgatagaggctgattctattccttggtcacacaagtttatccactttgtaataacgcactgagctttacatgaatgctttgtgcatgcatttctgtatgcatgttacaatatcaataacaattttaaatattacatttaaacacaaaaatcctaacagcatctcagaacaatggcagcactgttgtttgttttaaaacaggatatgttcactcatggcattatcagatgacttttaatattttgagatatttattcatgtcctaacccttggtaagtggcatggtttttatttttcatgatgcactttttttcagcaaagtcctcccccaaccgtgctgctcaccaaggccctggcacctagcacagtgccctgggaaacttgtaaatctgggttagatttgggacaaaacaggaagtagaggtcagttccttccaagagaagtaaataggtaatgcaaggaagattgaaaggccgcaactcagcagcaaatgtttttacattcatttgagaaacacttgcaaagagtttaccaaaaaatgttggtttaaagcagcagttttgaggactggctgcacactatggaaagctgttgtttatttatttatttatttttaagatgaaatctggctctgtcaccatcacccaggctggagtgcagtgtcgtaatcatagctcactacatcctccaactcctgggctcaaagtatcctccacctcagccaccaaaagtgctgaaattagaggtgtgaaccaccacccctctccattcctggggagcttttaacaatactgatgtcctggtttcactccaggaattctgggttcattggtctgttgcaacttgggtttagggggatttttaaaagcccccatgtgatcctaatgtgcagccagaggtgagaactactggttcatggtgagaggtgcattagctgtgcctcatttccatgtgtgctgtagcaatttgccccatggccattgctgcatttggatttttggaaaaaagctttgctgtgttaaaaattagagaacaacttcaagatgtactcaactgtgtggttcagtggcagcaggaggaagtgtctcccagcagatctatctttatgtcacttgcgttctgagtaagaggttgtctctggcacagtagtttatgatgaaaatcataaacaggcgtgctgaggtgggtggatcacgaggtcaagagttcgagaccagcctggccaacctggtgaaaccccatctctactaagaatacaaaaattagctgggtgtggtggcatgtgcctataatgccagctactcaggaggctgaggcaggagaattgcttgaacctgggaggtagaggttgcagtgatccaagattgagccactacactccagcctgggcaacagagcaagactctgtctcagaaaaaaaaaaagaaaagacaatcataaatagtctacaaataccaaaaagagatcaaaagaatttgcacataatactttggccggctgcgatggctcatgcctgtgatcccagcactttgggaggccaagacgggctgatcatgaggtcaggagatcgagaccaccctggctaacatggtgaaaccccatctctactaaaaatacaaaaaaattagccaggcgtggtggtgggcacctgtagtcccagctactcatagctactcaggaggctgaggcaggagaatggcatgaacctgggaggcggaggttgcagtgagctgagatcgcgccactgccctccagcctgggcaacagagtgagactccatctcaaaaaaaaaaaaaggatttgcacacatgtggagtgcattatcatgctttcaaatttctcctatgatgaggaatgaaaaatataatattgggccttgatttcctaaatggccctccgccatttccccaaattattccaacttttcccaagacacttcagaaacattctctggagggaaatattgcaaatggtgaagagtactagatggatgagaatcccatgggattcttgcttaaactgcagaagagtcaccctccaggacttcaaaaatttacggaagctgcatgagtagtgtgggctatggaagtcatgggcgtcgacgtcaggccgacttggtcctgagtccctgtccagcctcttagttgctgtggggctttggacaagttccctgacttgaaacacttatataaacctcacctgcaagaaaatgcatagtgatactgattgcaaaaatggcatcaattcatcatccttccctgtatccagaccctttgcagtgtgcttgtacagatgttctcattaagaagcagactctgtttcccaaaccttggatctcagctggccttatttgctgtggccaatagaagactgcaaacataacagtgtgccagcttggggcttaggctcaaaagttcttgaatgctttgtttttctttcagaattctaccatttccataagagcaagtctgtgctagcctgttggaggacgagaaaccatgagaagcaaagtgccacagttgacagccaactcacccccagaagcagagatgcctagtcaaccaaaagttaagcacacatgtccaaaggggcccagctgggtccagaagaatggcccagctgagcccagcccaaatggctgaacagctcaatcatgagtgaataagttttgggtgatttgttatgcagcaatagctaaataatacatgcacccagtgcagataggatgctaggattcaaggacaggttgattacaagttacctgcaaacagaagacaccctacagttgctgattttcttttcctcttatttaaagttgggcctcttgcttgatggcatcgagttacacagaaatgcatgtagacatgtctgcatgtaattggtgcttaaactacgcagtcctccacagcatgtgaggaaacaaatgtacacagcctgaccgttagggtcaaggccaaatagcaaagtaagtgtgcctttaatctattccctccatatctaaacttcgtaggtcaaggctgtggacagatctgaagacactgggtttcctccttttgggggccccatcatcctttgttcattttctgatctctggaaagacgatgggcagcaggtgggcagcagggaaacctgtggacactttgttcttgtagcccctgccctctagaggcaccatctctcactcttgggcctgaagagagctgttgggagggaggaggtgtcccctaacttctggcagaaaagagtgtttcagacccgtcacctccctcagctcagggcagtcagagtcctccgagctgcgcttcagtgtggtggccactggccacgtggggctgctgggcacctggaataagctgctttgcactgacgtgtgctggaaacttaaaaatccagagagttgccaaaattagtaccaaaacttatacactttattaacaattatatactggtctcatattaaaatgatcatattttggctatattgggtcaaataaattattacaatcaatttcacctgtttctttaatatgtggctattagaaaatttaaaatacacatatggttcacattttatttcttagaagactgtctcctttttgaaatctcaggctgcctgctcaaaggaccaggggccaggaagatcataaaaatccaaaattctaaaataattgtcattatgttgtttctacttgtgaattttatatatatataaaatatatatattatatataaaatatatatattatatataaaatatatatattatatataatatatatattatatataatatatatataatatatataatatatatataatatataatatatatattatatatatagtatatatataaaatatttataaaatatatataaatatatataatatatatataaaatatatttataaaatatatatataatatatataaaatatatatataaaatatatataatatatataatatatataaaatatatctatataaaatatatatatataatgtatctatataaaatatatatataatatatctatataaaaatatatataatgtatctatataaaatatatatataatgtatatatataaaatatatacatataaaatgtatatatataaaatatatatatataacttataaatgaatataatcttatacacaaggttaaatgtaaatgtccccagggcagggccaggcccagtgctgggagaaagccctgtctgaaaaacctgctgccaggggcctgtggttcttgcttcatccaacccagtatctgatggcatctcctgtcttcggtctcaccatggcttgcatgtgtggggccttctctccatttctcccaggccccttctgttctccctgttccctccatcatgtctcagactctggccttgggactagaagccccttcctagacctacctcagttgtcatttccccaaacctttcgcacaggttgaggactggactgcggtcctctctgccctgggaggcagtgggagctcagcaccacccacatctcctgctcccctgactccctcaggagagatttgtggtcttagcttgtcatcatcctctctccccagcttcagtgagcaggccagggctgccttgggaatcaggatggcgacagtgttaggggggctctctgaccacgtccgcatcacagaggagttaacttgttgtgacagacaggtactagggcagctctgctgatgacctaaccaaggccaaggtttgggcagagcaacaaatgttggcagcctccacctaccaggctttgtgctgctgtgcttctgagtcagtggggcaggttagataggaggagattggggctggctgacttccccctagcaaagattgggggaaagagttgaagtaggccgtgcgcggtggctcaagcctgtaatcccagcactttgggaggccaaggcgggcggatcacgaggtcaggagatcgagaccatcctggctaacacggtgaaaccccgtctctactaaaaatacaaaaaattagccgggcgtggtggcgggcacctatagtcccagctacttggcaggctgaggcaggagaatggtgtgaacctggaaggcagagcttgcagtgagccgagatggcaccactgcactccagcctgggcgacagagtgagactctgtctcaaaaaaaaaaaaagagttgaagcaacttgcccaaggtcacaccatgaccaagttgcttaggggagcacttggatttccacctcatggccggcaagccaaagctgcctggtctggcccggaggaaacggggactggtgtgttgttctgaatctcatgctgagaatgaggggctgtgcagagtctgttggagaatttctgggacagcatcagtgaagctccttctcaactgagggcctctatctggggtgaactgggtcaggggaaggcacagctgttcatttgggggaaactgggagcatactagtgggtaggacatcagcctcatgtccctgggaagctggtgtagatggctggggcttccattacagcagtcctggatctattgaaggaagccctaattaagatcctcagcatgatcccgcctgagcacctaaagtgaggctcctgatcccaggacccggctctataaaactcttcagtccgctcaaggatgagacgatgaaagccactgggggtggggcaagggtcagttaccttcttaggaataaagcagctggtaggggttaagagaacaggcaagcatttctgagttcacaggggagtgtccagttccttctgcctaggggaaggctccctagagctgaggcccagaggggaagagaagggggctggcagatgtggggggcttcagggagctccccaacaggatgctgaagctctctgggatgagatctggggagagtaactagaggagctctaggtgatcctctggccctgaagacctgcctctggcctgggtgggacagggaggaggcaaacagaggtgcccacctcttttggggcttccacaggctgcctgcttgcctcatcctcttttcttgaagctctgggttgctgtgatgggatggagtgatgtgccttttggggccctacttcctgctggggcttcacctgctgaggcctgggctggggtgcggcctggccctggcatagtctcccaagtgggtccatgccaagctggggaggcacacaggccacctggggtggcgtaagtgtcttttctcgctcctgtctgttgtgtgggctttctgtgctcccaggccaggacaagggtgtgcttcatctcttcaccctaatttctttcattaaggctggggaggcacgtgttcaagctgcatgtgtgcagagtgctacgagggcagccctggcctgttctccagagaggatctcctttttccctttccttaaagctcagatcctcagaggtggccctggaacatgagaggagggggtactggcccaaggcgtagaggtttctgcaggtcctatgactgggctagatctgcccctgggcaggtcctgaggcctggaggaggaagggggttctgctgacatttgggtgctgcagcctggtcccagggagcaggaccgcctggcctgtgctcagtgggggtggcactcaaaggcatgggcttggccatcggacatatctgaatgtttcttgacctggcttggctgcccctcgcctctgtgaccttgggcagctgcttccctgccctgtggagcccatttccttgggtgagatggggtggtcgagccgatttagggaccagctatgggctgggcctagtgtgatattgactgtagggtaaccagaatgggggcggttgtcaatactcttctgggtcactgtctggccgtcctgtgccgcttctctctctgtaaggtgagggtgtgtttggggaggggttgggagaggggttctgcctaggcctggcccttcttccctatgatcgttgtgtgaggtccagaaccctgcatggagctatgtagaaacacaggttctgcctgggtccctgggcctgaaggggcggggacggagggagagcctggctcctctcaccctggtgagggtggaagcggagccgtcctgactgggccctgaccacatggcagaggccctggggagacaccctggcgagctgggcatgctccttccccccagccacacagccctcagcctcttgctgccagctctgttccccctggagagacttgattccatcctggcagggcaggggctgtgaggatggaaaggtagagcctgccagcttcttagtggagttcagaggactggggcacgggggcagttgtcctctgggagacggggtgggggtgtctatctccctccctcccaccagaatgagtgactcacgggaaggaggtgcctgctgggccacctacagggggcagcaggagccagaggccccagccagccatttagcccaggaagcagacaaggcactcagtgtctgagactggtggactggggtagcgcctcgtggccttggactgggtctgcaccagctgttgccagcagctggccaaagcagctgcccgtccccctggggtgggagctgaggagaggacccccttgctgggcctgcccctgtcagccaatctcctaggccctcgatctttgcaggtccatgtaccccaaatgctgggctctcctaccttccagcatccttaccagcagcagccccctttctgaggctataggcaggtgggcctgagtgcagggagcaggtccccctggtatcctggagccactgaggcctcctggcccacagctgtcctttgggccaacctagagttagatgcaagtcacggggagtgcacccttcctggggccaccccagcaggcctggtcccactgaaacacaaagtcagctcgagctccagcccggggaccaacgactgcattagggcaagggtagtggcagagactggaatgatggacacaggcagtgccaggcctgggccagaaagctggctacttcgctaccatggccatcctgagactccagagtccaggagagggtggcgccaggtgggcagtgggagcctcgtgaaccagttggctaccctcttgctggggaggtcacttggctttcatccagagataggaagacgttcagggttctttggaggaagaaggaggggcaggacaggatgtctcggtgataggaggtccctgggggaccagccatattactttgaaatcttacccatgggggtggagggttccctgggctggggaggaagaacgggggctacctttccttgtcttccctcccctcccccatgcctcccatcccagacatgccaaggacaggctgcccatctaggtccagatctctggctcccggcttctgggatctcagctcaaaactgctgctgcacattgggcggaagcccttcctgcttctcccctcactccggtcttggcagccagcatagcttttctcagggacccagtgggggaggttcctcccacccgccctccctcttgctgcttcttgaaagctgatccacttctgcccctcctgctcctgtctgctctgttgtaagagtcaggcaggttttcacaacgtgatggggcttgtcacttgctaggggattggggttgccatgacattttctccagcttgggctttgacatctagtactactgtaaggattttggcagggatgtggtggcctccatagcacccaccacccacctgaatggcacgcacacatacaaggtggtgcatctggaggggctgtgcacgctgggcacagtgatggtgaataactgtggctaccaggtcatggcccagtccatcatcttcccggcatcttggagtggaaccagaagcagagcttcatctatggttccactgactttggcaagagggtggcgtcacagccacagtacctggagctgctgggtcactcaagttagacctcaagattctgaggcactgtgtattcaattattgagatgaggaggtagagctctgcttcttggtgggtgtcactggcaaaacaggcaccagtataccctcctcctgctgtgcatcttcccctgaccacagcttcctgcccgtgcccagtacgcagatgctgtgccagcttcccccatgcccaccggcaggggctctgctgcctgcaccaggagcaagtgagtggcttggtagagcactggtgaggagcagccctgggaggctatagctagagcaggctacatcctgccagagagcatggccacactgggttgtcctggggctggatccttgaagagagaagctttggaaagcgaagaagccacactcactagagcccccttcccatctcccacccaccctgtggtcagtctcccaaatgcagagatctacgttggttgcaaactagagagcagccaaaccagtgacccagctgaggcagtactgttcccttaaggagcacgtggaaatctactgggtggctgtgaatatcaccatgtcaagggtgggcaggtgggacactgggtgttggtgccactggtgtttcatgcttaggagttggccatgtcaaatgtcccaagccagaaataactctttctcaaatgccagtggcattcctgtcactgttgagagccccagcctgaatggggagcccctctctgcccccttcatactatagctgtcttcttcctggctgggtagatgttgggttttgctgtgacctgatgctgttgggtgtgtgcacgcccatgcaagtgcacactgggcaggatatgtccccatgcctgcaggttgtgcagccccacattcctcagccacagcaggccaggacgctgccaggccagcaaagcttccgaatccccctctaccatctcctgctccaccctgtctggtgtactccaagtgcctcctcttcatgaagctgctgccctgcagcctgatgcagcagaaagccagcaggctggagcaccctacctccctggaaaatagcactcttccttccttggagtcttagcttgaagaccctctgggacacaaggcaggaattgagaagggcagaagtgctagcagccgggccaaggggaaggggctggctgagagcattgctgcagaggacagcacaggtggggttgctctggatgccaggggagagcacccagcctgtcctggcagctggtcactgtcagtcatcgctcatgacccagcctctgagagaggcagggagatgcctccacagggagctgtggggtgagattcacgcagccactcctccaatggtggaggtgggccacctcccaatgtgccctgtccccacagtagaccctcgacaccaggaagtgatcctcaacgtgtgcaagggagtcagctccatcagcagcctggccttccacagaaggccctccaacctggacatcttatcaggcaactggtgggggctggttggcactggagcccggtggggtgagacagagcctctttgggggagcatctttggccctcggtgctggtgtgcctgtccagccatgtgagtgtggcgcctgccagccccagacagcatctgtcttaccaccccctgcctcccttctgcctcattcaagcttctctgctcctcttccaggcaggggttcacttccctgagtcctgccaagatgacgttttggaaccaggaacagctgctgaaagatgtggctgcctttttgctctcctgccaaacctctggcttggtgagggaggggtcatggggtgcgtgggggcttgcaagttttatcaccctagttgaaaactttttttcatctcctagtgtaagataaaaacttggaaagatgggtctcttgagatgttgttaatggggaccaagggtggcctagggagcacgtagggagcagaactcctgcatgctcttctggagaggtgtggtttttggaacttttctagagtggggggaaaaaataagatctccatggtcagtgaaagggcagttcttggagtcagctagtggttctgattccccttttcccacagcagtggactcgggtgggtgggctgagagggcttcctgctctaggaagcagaacagggccctctcccctgcaaagcgccagggaggccccctctagtccacaggcgggtgctcctgactttcccagcttcggcttcggggactcatatcttactctctctttttctctctctccacctccctcctctctctcctctctggctctgccctgtggctgaagggctcgcaggataaactcaagggcaaccctggggtgcaccctgccaccttctcggcccacactgtaccggctcattgtccctatggccagttcgagtaaggggatctccaggtgacccgagaaagccgcgtgcgagagcacaagcactctcaaggtctggctcaaggggcaccgcaagaaccccttccccaccaaaggcgaggagagaatgctggccaccatcaccaagatgaccctcacgccagtccccaccagcttcaccaacgcccaccggcacctcaagtagagcacggtgaagtggggcgcgcacagcaaggaccaggagcacggaggcctcttcgacagcgacactgagggcgaccccgagaaggcagagattgacctggagagcatgcatctccataagaccaacacccacgatggcgaccagaacaacgagggcgacgaagacaggactgaggaacatgcgcccctgccgccctcacccggaaccagggctcccggctggcagcgccaacgtgctcaaccccaaggctcgctcttgggtctggccaaggaggtcccagagcctggctgcaggcgccggttagccccagcgctgcagcgggcggcctgcagggtgagccacgcggggaagtccaagatctggtggctgcctagggcagcctcgcgcccgcagggcccgcccaccgctttgcttacgccgctgcccgtgggccaccccggcgcgcagggtccccagcccgcgcctccgccacagccggctttcccgcgcagccacggactgcactgccgccacgccggcaagggctccagctggacggagggggccttcctcgctccgggatccctgtcccactgtgtggcttcccgaggcctccccttcctgcgccaccaccaccgcagccgcccgtcgcggtggtcaggggcgctccgcggagaccgagaccaggccccggcccgcagctccgcgcgttcccaggcgcagctcctgatgccaagttcacttggaccccggctgagattagagaggcctggcgaggtgtgggggtgcgcagggagaatgggctgtggtcgccatggtgcgtgttggtcttgtggagatggatgctcctccgggtcaatctctgccttctcggggtcgccctcagtgtcgctgctgaaaaggcctccgtcctcctggtccttgctgtgcgctccccacgtcaccgcgttctccttgaggggccggcgggcgttggcgaaggtggtggggactgtcgtgaggatcatcatgggcagggaagggcgcgcggcagtggcctcgagccctgggtcttctccttcctgaatttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactggcggcggcggagcgcggcggggaagctgtgggggtcgtgcgatggttatggagagtgctccatccgccaggcctgggctctgggcgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctctcgcatccgcactgatccgagctttaacattttctttccagcccgcgaaccacgcagctccggactccaggcaggaagcgagggtcagggtcctggaagaaagcactctgtccttgaattattcacccctaattgagttatcgtgacaccctgtggctttgggaaacctctccacaaccaagtggagccacagccctctgctaatgagggtagaaggtcgaattagatacacatcaaaagtggcagtaattaagccttcatttgatttacacctggggcacatgcggctcatagcccagatagcctgtgacttagaaatgggtttgaatagaaaatctacaaaagtatgttagctgtaactgccggtggtggcagaagcttgttcaagttcaatagtgaatgttcaagacaaaaacaacaaaaaggatttagtgtaaccttttcacacgtaatttattttggtaatctcttattttgcagatttaatctgcatccttttgtgttttcattttgttttaaccaacgagtaaaatggtaaggtgacttgcagtgagactgaaatgtctatgtggagatacaggataaaacatatccagggataagtgttttgcaacaagctgtgccaagggtttattcctcataagtgtaataagaactaaaaggtttttgttgttggtggtggttttttttgttttttgttttttttttgagacagggtctcactctgtcacccaggctggagtgcaacgaacggcgtgatcttggctcactgcaacctccgcctcccgggtccaagcgattctcctgcctcagcctcctgagtagctgggattacaggcatgtgccaccatgcccggctaatttttttgtacttttttagtagaaacagggtttcaccatgttggccagcctggtggtgaactcctgacctcaaatgatccacccaccttggcctcccaaagtgctgggattacaggcgtgagtcactgcgcccagccaagattccttttaaaattaaaatgtactggaagagaagtgtaccttgctcaccttaaaattatttcccttaagttcatctatttttgcacaacatttgatttgagggaatttttaaaaattactgaacctattgttactcaattttgatttgatattctcagcaatatacaggattccagctgacttgcagaaagatgaagagtgcagcagcacagttcaaacattagaactttcttttttctttctttctttctttttttttttttttgagacagagtctcactctgttgtccaggctggagtgctgtggtgctatctcagctcactgcaacctcccctcccgggttcaagcaattctccttcctcagcctcccaagtagctgggaccactggtgtgcaacaccacatccagctggcctagaactttctgagtaaaacaattgcttaagattttagaatcaatttcccttattctttttctctctgcagttaaaaaacaatgtctaacccatgcaatgagcttttgactatatgcctcatttcaaaaggaatatgagatcattgagttggacccagagaaactgaactcagagaaaacttccattattgagaacccaaaagctaatggccagacaaaaggatgagaagaaatgctggacctccagtttgttattaattgctcttttttgttttgttttgtttcgttttttattgagatggagtctgtctctttcgcccaggctgcagtgcagtggtgcaatgtcggctcactgcaacctctgctgtccaggttcaaacgattcttgtgcctcaggctcccaagtagctaggactacaggcatgcgacaccacacccagctaatttttttgtatttttagtagagacggagtttcgccgtgttggtcaggctgatctcaaactccttacctcaagtgatccacctaccttggcctcccgaagtgctgggattacaggcgtgagtcaccatgcatggccaattgctctgtttttcacaagggactctgccttaagctcattttcattgacttatcatttctgggtttgctctggtgtgaaaattctcattaaatttttttcttcagattatcgctacttcagaaaaaataaaaactacataatttataattcatgtcacaaaattttgatggcacactgtggcctgtcagagatttctttaacattcctttttgtttgtttggttttggcttttggttttttattaaaacagctttactgaaacatgatttatacactatagaatttatctgttttaacatacagttcaaagattattagtaaatttactgagtcatgcaaccatcactacagtccaactttagaacattttcatcactccaagaagatgcctcatgcccattagcagtcactacacatttccaccccagccctatgcaaacattgatctactttctgtctctatacatttgtctgttccagatgtttcatgtaaatggaattatacagtatggtaaacatctttttcatctacttatttttatattcaactaggtttaacatgtaaccataaccaaatatttaaattttctctccaggagcttgaaaatatttatttttcttgatacttacttcgccttctgatttctgttttttatactgaaacagtcttttaaatgatggcattcattgattaattctttatttttctcttctagcagaccttctttttcactctcgaaacagcagccttggatattaattactatttgttcattatcccctttcttatgagcaccatctagttgctgttcaagctacagattttcatgttgtagttgagatatccactcgtctacatagtcttgctttcctttatctgatgctgtgtttggcttaggtcctttggcacacttttttttgaggcaaaagataacaataagttactgaacaactttctaaagctggaattaaattcaataccctaaaaagtaaactccatgagacaagaagttctctcagagaattttgtattgttcagatggccaaattaagtcatcaaggccatccttaaatgtgttcgctttttgacctttttcttttgacgctttcttcgcaggcctgtcatactcgtctttctctttcctgggaaattgctgatggtaagttttcgcaccttgattttgttgcattgatccatcatcatcgtcagcagatgtactattatataggttttctgatacttgtatatatatatatatatttttttttacttttgtgcttcttcctccttcaacctgtggttatttattttcacttttctcaggcctttcttgttcttcctttgaagtcacttctaagtcttgttctgctctggatgtttatacgtcctttctttttactgcattcttcacaacagactcttccatttcggtggtaggcttcaaggaaagatgttttacaggagacacttctacttttaccatattttttttcttttttatatgaaggttcaagtaaagactctgaagcagtctcagggatatactgcttggtagtaaaagtcaagtcttcatcatctagtttacggcatgaatcaacacacagttgtttgaaaatgctgaatgcagatttgtcagaactccctgaatcttctgcacttgctcctccttctctcaaacttgcattctttgatgcttctggattgtcattttgaagaccattttcaagtatctttttttttatgttgcaaaatttgttgttgaatgctagtcaaaacaccacaaatagcataattgtttgctgtctgtccatacatatcttgaataaagacagtaatattttgttgaagaatgccaactatacctaacgagccataatgtacagcaggcgtgaaggctgttcctctcaacctatcaacagcatgtgcatttgcttgtttcttcactaaaaattccagcatttgctgtcttttgcaaactgcagcaagtaaaagtggtgtgtttccatcattgttcagcacttcaatatccgtatcatgggaaaatagtttttctaccaggaatgtactctcattataggacagcatagtggagagcagtgttgctgtagacatccacgttccagcagaacgatgccacaaatctcttcctggcaatgtacagcctcctcaaaggcatcccattttgtttatcaccaatgtcaatgtggcattttcagttcaccaggagagtccccacttccacatggccattggcacaggccaaacgtacagcagccctgtccatccacagctgaagggatagagaaactgccatacagatacacacagagtatgcttcagccataaagctttgggaaatcctgtcattcgcagccacatggagaaacccagaggacattaggtccaagaaaatgagcctggtggagcaagtcccacactgcgtgacctcaggcatgtggactccaaaaagctttatctcctgcccatccacagatgaagggatcaagaaactctgatatatatacacaaaggaatgttctttggccatcaagataattaaaggatgtcatttggaggaacatagatggcccgccgaggctgcggctgcctcatcctgcactgtggatggaagccgctgatctgacaggaagtggagctcaggtggtaatgctcgctcttgctgtgctgccaggttcttaacaggccagggatgatactggtccaggggtgggggagccctgctccagatgacagccagagtagtcttaaatgtaagttggattgtttgttccctgcttagacctttagccatttcccattaccagaatcttcggcgtggcctgcgtggccctacttgatctggcttctgtcctcccaccctccctcgttagcccccatcatctcatgctactccccctcgcccaggccactgcccagatatattcttctccttgggcaagaagttctgtgcatgcaggtcaaatctgaaagggacatttctttctttaatgagtgtcagggatgggggatgtggctgatgatataaggggccctccaatcagactttctaatctaactgaaaagataattacaatgttgatgctaaaaaagaaggttctggcaaaatagaacttctgaagcatcataaatcagatgactaatatttgtgatccctttttaaattttcatgtgaagaagaataggggatgtaactgaagaaatgaactaaaagttcttctatgtattgataacctaagtgtgggatgctgtttggctctggaaacacgtggcctcctgatacttaataaacaatctagcatcacacatgacctgtattaaaagagacacttcagtgctgaatagtttggtgctcaaagggcaggagagccagttagtgcttggggaggcagagggggaaccttacctgatggccagggacgttgggactgactcagtccatgaactgtgcttacctggaagaaaggcaaggagttgaggaagagagaggagatggaggcaattctaggcctgagatgggtctgagaatatctgtgggtaataagaccaattaagctagagtagaagggtcatttgtggagcaaaaggttgtggattgtgttgtacatggaatttcttaggccactgtggctcttagcagatagtgaaatcaatatagaggatcttgtcccccattaaaaatgttttgttttgttttgtttttttgagacagtcttgctctgttgcacatgctggagtacagtggagtacagattcttttaaaaaatacaagttaaagattgtgatagaaatatgaaaactggccgggcgtggtggctcatgcctgtaatcccagctctttgggagcccgaggcagggggctcacctgaggtcaggagttcaagaccagcctggccaacatggtaaaacccccgactctactaaaaatacaaaagttagccaggtgtcgtgatgggtgcctgtaatcccagctacttgggaggctgaggcaggagaatcacttgaacccgggaggcggaagttgcagtgagccgagatcgcaccattgcactccagcctgggcgacagagccagactgtctcaaaaataaaattaaaaaaaaaataaaataaaataaatagaaaaaaaggaaaaagaaattattaaaactgtcttagttttgattcttggtttaatccagttcaaactggtctaagtcaaactaaaggaatttataataaggacacaagagttttgtttttgcttttgtctttttcacagactccaggagtagacatacaggccaggtctcacatgtaaagcatcagaacacctttagaaaggcaagcagcacctctctgtttcttgcctctgcatctctctgtgcttctgtttcattttctttcaggaccttctgctttgcacaaaggtggtatgcaatcagaagacgtctgaggagacaagtatgcatctcccaccacaacattatatgatgcttggagtaaaaacagtcctccctgttcctacccacgaatgtattattcaataaagattgctgccaggcatggtggctcatacctgtagtcccgcactttgggaggctgaggctgggcagatcgcttgagaccagggtttgagactagcctggacaacatggtgagccaccatctctgcagaaataaaataaaataaaattagccaggtgtagtggcctgtgcctatagcctcagctacttgggaggctgaggcaggagaatagcttgagccctggaagtccaggcaacagtaagccatgatggtggcactgcactccaaactgggtgacagagtaagaccctgtcttaaaaaaaaaaaaaaaagattgcattattcaatcttttttcccatatataatttatatagttacataattacattctagtttttgcacatgccgagaactacatataatttagtagtatgctgttttcacttatatatcacatatattttcctatataggtatataatatctatatttgtccttttccatttgactgctgtgtttcttaaattgatatactgtgatctaagccagttacagattggtatggatttaaattacttcctattttctgttttattaacaataaacactgttatgatatagttttcatttttgtttgtttggtttttgatcatttcctgtggaagtattctcaaagctgaaattactgaattagtgggaacaaacatggctgtctttttaaatgttttgtcagcttactctccaaaaggattacaccaagaggtattgccactagcagtagttaagagtttgtctcaccatgattacaaatttttcaaaattggtagcttattcacactgattggaacatatgaattgttcaatattttataatatgtatatgggaaaacccttatatagattaatcaagaacatataagtatgtaataaattccatactggattacatcgatgatccttctggctctgcatcttgaaacctagttaagctcttttatgttaaattcacccggatagagttttggaaaatacttgctttttatttctgaaagtttttgcaaaggattaggtttggttttatgaaaagtttcgtctctgaaattatctgcctagactttggacaaggtgttctattaattgtcaaatacaattgaattgaatcacatttttctttctaggttactttataaggtgttcctacaggtcataaaaaaattgcccacaaggagccaaattactttattcatggatctaatattgctttatagtattgctatataggtttagataattatgttgtttcaccttcagtagtcatattttagttataggtaaagtcattcctagttaaaatagtatgtaaagcaaacacatttgaaatcaccagtattcgacatgttttgctattacttacaagtaacaatttacattattttaatgttgtaaatagttgtggaatttagtcattttctgtatattgaattaattactggcattaaataagtatcttctctctttagtagcttaactcatttcctgaatgtacccatttgatatcatacttttgattggtaaagtcacatgtaaatatcttttttactttttataaaataatgtcataaaaatatggaagattttctggcagacattattagctaactgatgacattttcagtaagtgccaaaaagtaatatatgaatatataaaacatcaaatatttagcataaactttataaatagcagaaatgattagtagaagaaattactcacatattgtctgctaaaataaatattaaaatttgactacatgaaaaaatatagtttcttgagctgatcaaataaattgatcataattcttcctcgttttgttttctgtgtctgtggaagtcatagcgaatcccgaaaatgtatagcttgaattctgttgggttttttttttctttattacttagtttacatacatttttgtcctcctttgaacttactttctccagacttgggtatgtcatgggcataaatcaaaccactcagatccacttctggaggttgatgttggttttaaagcaggtccttgtggcatccgttccctttccattgctagtcagtacagagcttaccttttatcaaccagataaaaggttctgatgcaaataatttgacaacccattagctagaaaactatttcctgataacttaaaatcgaccgaagccttcccccatatgtaacactgttctgccattcccttcatttttgcagtcctcctttgtatagccttggaaaacagatcagcgaggtagcagtgaaagacatcatgataccaaatagaaacaaggacttggaagacacattggacctcttaatttccaggccacttgatagtagatacagttccttacaaaagaacatggcttcatcttgggaaaagagggtgctggaggtgagggaagatgaattagccaccaagacagttcaccttgcaattcaatcatttaggtctaactggagaatgattgctgccatgttccagaacaagaatgaaagcctcgtttcacaatgaaaaggtgaatttatatcttctgtgttagattctaggaaaaaaggaagtaaaagagatacagaacagtcctttcatccctccccatctgcactttattcttcctaactacaaatcccatgctgaaattctactgtacttgataagcatacaatcatattcagggctctgccaggacaatattcttttttttttttttttccttgaggtggagtttcactctgtcacccaggctggagtacagtggcgtgttcttggctcactgcaacctccgcctcctgggttgaagtgagtctcctgcctcagcctcctgagtaggtgggactacaggtgtgtgccaccatgcctggctaatttttgtatttttaatagagacggggtttcaccatgttagccaggctggtctcgaattcctgacctcaggcaatctgccggcctcagcctcccaaagtgctgagattacaggcatgagccactgtgcctggccgacaatattcttaagtataaagaacatataatagttggaaaaatctatgagcagaaatattttaggggatattttgttatatattcagtatttctataaatgttttcaaaatatacaaaattttgaatgacataatgctttctgtatttcctcttctccacttgggcagttctgtgaacacaaaacatcccctcctgctctgatgtttcactttttatatggttttgattggtgtccccacccaaatctcatgtcaaattgtaatccccaatgttggaggtggggtctggtgcaggtgattggatcatgggggtggatccttcatgaatggtttagcaccgcctctttggtgctgtctcctgatagtgttctcatgagatcttcctcctgctcccaccatgtaagacacgccagcttcccctcactttccaccatgattgtaagttgcctgaggcctccctggaagaatccactatgctttctgtaaagcctgcagaaccatgagccaattaaacctcttttatttgtaaattacccagtttcaggtatttctttatagcagtgtgagaatggattaataaaactttccaggaagatcatttcattccccattctttgtccctttccatctgccctttattctttattgattcccctggtctctgaccacccacctcaaatttttaccttatttattttataatcaattgttccatgcgttatcatgctaaatataaaccctttttatgatgatagacatcatgactaataacttctgtaatagtgatgaggatatctgaaaaacatatatttaaaaaatagatacaccatagatatgacatctatgactggtataagaagaaggttctaattggaagctgatacagaaggagatcagcttgtctcagagcacttaataacctgaatctcacccaatacaaagcacaaaggctgaagacgtgatagcccttttaaagtgagctaccagggattaaccactaaattttagtaccattgcatatggtatttgtatattgtatctctgagttctgtgagccaaagaagaaaaggttgatttttggagcaagcatctttaccatgactaggcaaaataaaaaagaaatagaagtcagagttgatagatgtccactatcaaaaacaacttaccttcggctgggcgcggtggctcacgcttgtaatcctagcacttcgggaggccaaggtgggcggatcacaaggtcaggagatccaagaccatcctggccaacatcgtgaaaccccgtctctattaaaatacaaaaaattagccgggcgtggtggtgtgtgcctgtagtcccagctacttactcgggaggctgagccaggggaatcacttgaacctgggcagcagaagttgcagtgaactgagatcgtgccactgcactccagcctggcgacagagcaagactgtgtctccaaaaaaaaaaaaaaaaaaaaaaaacaacacttacattctaaattagaattgagtggctgagtagctctggaataaaagagatctggattgcccatgaatgtgaggacacatgacatacacctctggagttatggagacagaagaggtcaagactgtaacttctgagtgaatacttctcatggggaaaagtaagctgggagaaaagctaatattacattgttggtagcataacccacaaacacaatttaaaaattcctttgggacataaaatatgttaatgtagcatatggaaccaagatgtaataactgtagtagttccttctggaccaaaataaattgctaaccacatacataatttattttcagaaccctcaaggtattatgcctccagcatgcacattctaaattagttaaacagaggaatcaagaaatggtcaaaataagggtgagggaagcaagagtttctaaagctatcacaagatgttgtagttgtcatctctagaaatttaaacagcagggtaaactttctcagaaagatgtatcataggactatctctagtcaaaaatggttgcagaatgggcagaaatctcagaagcctaccaaaaaggtaatttaagcaaagaaagaaaaaaaggaagggagtgaaggaatgagagagggagagataagaatttcctaccaccaagttaaaaagaaaacaataacaaaactttaggagactgtaaagtcattgtgtctcagacccaagattggtttctataagaataaatgtagtcgcagccaggcacggtggctcacgcctgtaatcccagcactttgggaggatgaggcgggtggataacctgaggtcaggagttcgagaccagcctggccaacatggtgaaaccccttctctactaaaaatacaaaaaattagccaggcgtggggagcgcgcctgtaatcccagctatttgggaggctgaggcaggagaattgcttgaacccgggaggcagaggttgcagcgagctgagatcacgccactgcacgccagcctgggtgacagagcaagactccatctcaaaaaatatatatatagtcttagttttacacagagatgcatacacatatacacaagatgtagtgattgagactcttaaagagtaaaacaaaatgtatgttaactggatatctgagaaaaatgattat

SEQ ID NO: 1794 - DNA, 4349 bp, Homo sapiens
gttaccatgtgtgtttatcacaatcaggcattgagtgaacgacaggaaaacaacaaaagacacagctggaaaatacatagtttctttaataaccatggatgtggaaacacagagactgttacatagtgctggggaaaatataacatgttccccagagtttcacggtggggtggggggcagtgggcgaaactacctgtgaggagaaaagcttgtacttattgcaaagcattttgtgccatttagttgttgcaaagccattttgtgccagaaagcttctacttatcacaagaagttccttttgccacattcacgtctgaaggagtgggtgggaaggaccccatcctcccacacacctgacatttctggagactcctgcgacagacatcctccttgctcctgaggtgcaggtcaagcccagagcatttggcagtatttgctgtgatgctgggttagacaaaggcaaccgtcccaggagcatctcccactgacccagatttctgtctgtttcagtgaaactgtagatcataaccacactttgtacttaatcacaaaatagttctggtgttttaggaagcttttggcctagaaatgaaaaaatttttatagagcgaaaaaattttatatagcaaaaaaattgttaacagctttcttttataatccaaaatttattttattttatttttatttttattttttgagatgggctgcagtgcactggtacgatcttggctaactgcaacctccacctcccaggttcaagtgatcttcccagctcagcctcccaagtagctgggaccacaggtgcatgccaccacacctagctaattttttgtattttttgtagaggccaggttttgccatgttgcccaggctggtctcaaactcctgagcttaggcaatccacttgccttggcctcccaaagtgctgggattataggcatgagccaccaagcctgggcacgttcttactctgttagatttttatgctgcactgcctcctcctgtctagaacagtagctaactgtctcctggcccacagacacatccctgatctcatcttgcctttggacacaggtagataccatcttgttctcttaaattttcatttcatttctcaggttttcgtttcattcatttctctttttttctttttctttttgaaacggagtctcactctgtcgcccaggctggagtgcagtgatgcaatcttggcccactgcaatttctgcctcccaggttctagtgattctcctgcctcagcctcccaagaaggtgggcttacaggtgcccaccaccacacctgggtaatttttgtatttttagtagaggtggggtttcaccatgttggccaggctggtctggaactcctgacctcaggtgatctgccagcctcggccttccaaagtgctgggattacaggcatgagccaccatgcctggccttcatttcattcatttctgttgtaagcttagaagtagcagcctcttcagctggggtgggtgacagtggtagggaggccatcctggccatgtgcccagggcagttatgagtgcttcatgtcttgtgttaggggatgacagagtaccctctgggatgcacacctagacacaactgacgactgccctttttattccatttttgtcgttacaggaaaagtcttgcacgaggagcatgttgaactcttgatggaggaattcgctttcctgaaaaaagaagtggtggggaaagacctgctgaaagggtcgctcctcttcacaggtcagtgctacgtgggatcacaggtcacatgtgaggtccaaagaccagccagattctttcctggctctctgggatgggagcttatattcatttctgctcaagactctctgactcagggccacttaattttcccagatgggatttaattccttggtggcccttgggtaaagagtatgttagaaatctcaagcatatttgtgctctgtcccaacctattaactagttggagattatttttcaacaggaagttgtacattaaaactcttttaaaaggatgagaggtgcttggagaggagaacatttttatacttccttgcaaagcaaatataatatgaagagctcccttcctcctctagcaagttacaaggacattggcagcaaccacagtatttatttatttatttataataaataataaatatttacttattctgttcttactctgttgcccaggtcttactctgttgcccaggctggagtgcagtggtgcaatcatagctcactgtagcctcaacctcccaggctcaagcagtcctcccacctcagccttccaagtagctggaaacacagatgtgcgccacaatacccagctaattttaaaatttgtgtaaacagtgtctccctatgttgcccagcctcatctcaaactcctgggctcaagtgatccacctgtcttggcctccaaagtgctgggattacaggcatgagccaccgtgcccagctgaccacagtatctgatctgtatttgtagctgtttacttgatgttggtcactctttgagcagctccgttagcaataggaaatgggcatgcaggaagctcctgctcttgtggccacttttggatgggctccttctctggccgtatcgttgggcacctgggccaccattcctgagggctttcattacagaaaggagaccctgacatggcctggcatttttgcacggtaaagccactgatacatagtagaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgatatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataa

SEQ ID NO: 1795 - DNA, 3181 bp, Homo sapiens
acatagtagaacctcatttcaaaatctgtcttcatccttgaaaatggtaatataatgagagtacaaaccattaatttgtacaagaaactgtgttaagttaagtaagttaagtacaagtaactgtgatgtgcattaatccatatgacaatcctataaagtggtattcactacccccattatacagataaactgaagttcagaggcatgagtggcttcacagaggtaacgtagcggtcatgagacagagctggattggagctcagctctctaagtggctggaactgttgtgggtggctgcttagtattctgtccaaagaactaggctgggcatagtggctcacgcctgtaattccagcacttggggaagctgaggctggtggatcacctgaggtcaggagtttgagaccagtctggccaacatggtgaaacaccgtctctactaaaaaaaaaaaatacaaaaattagtcgggcatggtggcacgcacctgtaatttcagctacttgaaaggctgaggcaagaaaatcgctttaacccaggaggcagaggttgtagtgagccgagatcgcaccactgcacagcctaggtgacaacgagactctgtctcaaaaacaaacaaacaaacaaacaaaaaagaactagagcagacagtaaccagccctggggaagtctttttgttttgtaagtttgatacttaggccccagtgatttcaaaccatattgtctatgaaaattctaatttttgtttggttttatatataacttattactttttaagaatatactcattgttattagtcattgttttaagtgaatatcaaggtcataagaaatgttttgtttataatgtaatgtaacagatatgaagtcttttaaacttaggttatgtttaagattttggctggaggcagacgggagcagtatcttgaccaaatggatttctcacaccaatactcttttttatgtttatatatatatatttttttgatatagggtatcactctgtcacccaggctggaatgcagtggtacaattatggctcactgtaacctcgaactcctcaggcccagatgatcctcccaccttagcttcctgagtagctggggctgcaggtgtgcaccacgacacccgcctaattttgtgtgtttttttgtagagacagagtcttgctatgttgcctaggctggtcttgaactcctgggcgcaagcagtctgccagccttggcctcccgaagtgctggtattataggcatgagctactgtacgtggcctttttaggcttactgcaacctctgcctcccgggctaaagtgattctcctgcctcagcctcccaagtagctggggttacaggcacccgtcactatgcccgggtaatttttgtatttttttttactagagacggggttttgccatgttggccaggctagtctcgaactcaagtgatccacccaccttggcctcccaaagtgctgggactacaggcgtgagccaccacgcctggccccaatactcttttgagtgtacttttttgttcacaagattaggaagactaagaaaacatttaacattgtatcaattttcttgatattgaaatagctcaaaggtattaccattttctccatagctattataataccttcataccttattgccacttacacatcaggtagttataagaatacaggcttgcagggctaaaatactttgattcttctacttttaccagactactttaaatcactaaagaggatatatatatatgtatatgtaggtatgtgttgtgtgtgtgtgtgtgtgtatgtatatctacatatgtgtacatagatgtatatattagaagcctgaaacttttttattatcctgtttggctggattgactgctgtttccagtagaatgttttactaaaactcaatttaataaacaggaaaagacagagatgcttttatgatagagttgaagttcagccacctgagttttcatcagtatcattaatcacgttgcctgcctaccacataaggcaaggtcccattgtactgatcactcggccacatcttttcacacccccgccacccccacccccctgtcctgctttccacttggcattcctgcttcccagttcccacagcatttgtgatttcccacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaaggtaagtcatgagaagccatgaggaggaggaaatttaaggacatcctagtacatttgcaggtatgatccaaagggagccccgaggggctagaccctcactcccagctccagaagggctgtctgcttctgcagatggagtgctgagattgcacttgtgttgcctcatctcatcctctcagcagccctgtgaggtaaagaagacaaacataatcccatctgccagtcagtagacagaggcttacagaatgccagcaggttgcctaagtcatgcaagtcattcatagcagattagtagtggaaattacattaccttggctgggcgtggtggctcaggcctataatcccagcacttggggaggccaagggtggtggatcacctgaggtcaggagtttgagaccagcctggctaacatggtgaaaccctgtctctactaaaaatgcaaaaattagccggtgtggcggtgcatgcctgcagtcccagctccttggcaggctgaggcaggagaattgcttgaacctgggaggcagaggttgcagtgagctgagatcaggccactgcatttcagcctgggcaacagagcgagactccttcttgaaaaaaaagaaaagaaaaagaaattatgttaactctgtgacctgatttttttcctgtgttttcttatgaaagttttcgggcatattgtgaagttgaaagaatttttaagtaaacacccatccacctactccctagaccctgccattaacactgtacatgttccccgcagggccacacattcacccctcagtgcagccagagtgtgagggtctgtgtttcagctttagcatcccatcaccctgtcacactgttcccaaaacattctgactta

SEQ ID NO: 1796 - DNA, 2275 bp, Homo sapiens
actcggattttatcatctattcccttttatcctgtctttgttcagcattgatcacagcccacccggtggattttgacatgtctcaacccagggtttgaaaaccagtgatctgtacagaagttctcacagaaagaatgatgtctggaatttgctgtaaaatacttcagtaaaacaacaacaacaaaatgctgtggggcacagggaggcgtcaccatgagagcagcgggatgctgtttactgttgagactgggagataggagagcatgacatactggtgtgtttgtttgaaaagtaatgaccagcctgggcaacatggcgaaaccccatctctacaaaaaaatacaaaatttaaccagtcatggtggtgcatgcctgtaacccaagctactcaggagactgaggtaggaggatcgcttgagcctccttgaagtggaggctacagtgagacgtgatggtgtcactgcactacctgggagacagagcaagaccctgtctcaaaaaaagaaaagaagtaataaaacagtcagaagagaaacaactgtattttaggtgacagtctggggtcaatattaagttttctgattctgattattgtactgtgttctgtaagaaatggtccttgctcggccgggcgcagtggctcatgcctgtaatcccagcacttagggaggccgaggcgggtggatcgcctgaggtcaggagttcgagaccagcctggccaacatggtgaaaccccgtctctactaaaaatacaaaaattagccaggcgtggtggcaggcacccgtaatcccagctactcgggaggctgaggcaggagaatcgcttgaacccaggaggcagaggttgtagggagccgagatcacgccattgcacccataggctgggcgacaagaacgagactttgtctcaaaaaaaaaaaaaaaaaaagaaaaagaaatggtccttgctcttagaaaatatacactgatggccaggcatggtggctcacgccttgtaatcctagcactttgggaggctgaggagggcagatcacctgaggtgaggagttcgagaccagcctggccaacatggtgaaaccccatctctctactaaaaatacaaaaaattatccaggtgtggccgggcgcggtggctcacgcctgtaatcccagcactttgggaggctgaggtgggaggatcacgaggtcaggagatcgagaccatcctggctatcacggtgaaaccccgtctctactaaaaatataaaaaattagccaggcgtggtggcgggcccagctactagagacgctgaggcagaagaatggcgtgaacccgggaggcggagcttgcagggagccgagatcgtgccactgcactccagcgtggggcacagagcgagactctgtttcaaaaaaaaaaaaaaaaaaaaaaattatccgggcttggtggcgggcatctgtaatgccagctacctgggagatggaggttttagtgagctgagattgtgccactacactccagcctgggcaagagagtgagaccctcaaaaaaaaaaaaaaaaaaagaaagaaaatatacactgacgtgtctgggctcaagagtcatcatttccgtaacttaactctcaaattgttcagcaggaacatagtgatacgcatgaatacgtgcagggagagatgaggacacgcgtgtaggtaaatgttcatttctggcgaaggatatttgcagggcctcttcatattctcacaactcttctttaactttgaaactgcttcaagaaaaaggcttaaaaaggaaagaaaggcaacatccagaagagacagggcagctcagtgagagtctgcgcaatgcctggcctccccaccatggtctcccagggcaggatgcgggcggcagcatgtgcgtcagatcgcgttttcctgctagcagcttctacagcttggtggagatgcgttcctggggccaggctctggccgagcaaaggatctgtattatgccgtgccaggcagcaccacctccctgaagaggtgtctggaactgacaggttttctctgaacagctgtcttgcaatttgaaagacccctacctcaaaacacacaggggaaggaaggaaggcagggagggaaggagggaagaagcaaaccagaggatgggggaccaggagcagctccagccaggattcaggtgacactgggggcaggatgcagtgagggtcaggcaggtgcagcatcgagggtggtcacgtccacatatggcaatttgatgtggggtgtgtggaactcccacgtggagagt

SEQ ID NO: 1797 - DNA, 2841 bp, Homo sapiens
ttttcacacagcaagttttctcatctcccacagtgtccctgaacttgccctcattgtcatcctgcttctgcctccctccaaggacagcacaaaggcggcaggcacaggactggctgaagggacaagaaagaattgggagtctagaggagctgtgccacctcaagcaggtcatttcccgagtctgaggtgctggggctcggtcccccaggttctgtgtcctcctctgccaaacaggcattgagccaccagcctccaggacagggcctgggacagagttgtcaccatcatcttcatcatcatcattgttctcatcattcttattgctatagtttggatatttgtcccttccaaacctcatgttgaaatttgattcagaacactgggcctgatgggaggtgtctgggtcatggggcaatctctcatgaacagcttgcttggtgccgtcctcacagtaatggatgagttcgctccctattggttcctgcaagagctggctgttaaaaagaagcctggtggctgggcgtggtggctcacgcctgtaatcctagcactgtgggaggctgaggtggctggatcacttgaggtcaggagtttgagaccagcctggccaacatggcaaaaccccgtctctactaaaagtacaaaaattagctggctatgatggtgcatgcctgtaatcccagttactcaggaggctgaagaatgagaatcgcttgaacctgggagccagaagttgcagtgagccgagatcatgccactgcactccatcctgggtgacagagcgagactccgtctcagaaaaaataaaagagcctggcaccttccctgcttcccacttgctgccaccctctcgccacatgatctctgtggctccccttcaccttccgccttgagtggaagcagcctgaggccctcaccatcctggcgccatgtttcttgtccagcatgcagaactgtgagccaaatgaaacttttttttttggagacacactttcactctttttgcccaggctagactgcaatggtgcgatctcggctcactgcaacctccgcctcctgggttcaagcgattctcctgacttagcctcccgagtagctgggattacaggcatgcgccaccacacccggctaattttgtatttttagtagagatggggtttttccatgttaatcaggctagtcttgaactcccaacctcaggtgatccgcctgcctcagcctcccaaagtgctgggattacaggcgtgagccacggtgcccagcatgaacctcttttctttataaattatccagccttgggtattcctttgcagcaacacaaatggactaagacaggtgtcacctcactactgttgtcatccttgtcactgtcatcattgttgctgccacctttaccatcatcatcctcatcatcgtcatcagtgtgattgccactaggtaccaccagggcacccccactacgtggccccaattccacagtgtggcctgttgtgttgggggtgaatttatgtgggagtgtggagagccctgtccactccctttgagatctggggccagcctcctgcagagaccacagatgctttcatgcgagaggccccttagatgagctgaaatgtctgagaaggaggagttacagctttgattctacatctgtctgaatagaagccatacagttgtctaaacatagggaagagccactgttaccttaaactttatcatcatcgtcatgacaatatcagctgatagatatccagctgttttcagtgtgccaaattctgggccaagtttgctataaaaacgatgccactgaaccctaacaatgccctaagagataaacattatcaccatcctgttttataaatgaggagctggggctcacagctgtccagcgactcccagcacccagggctagcaagctacagctctgggctgccagacactaaagccaagcccacatcactgcactgggttgcagtgttctattccacacgccagaattctagattgtttgagtttgttacaaacacacgtatctttgtaactagaaaataaagatttaaggccggacgcagtggctcaagcctgtaatcccagcactttgggaggctgaggcgagcagatcacctgaggtcaggagttccagaccagcctggccaacacggagaaaccctgtctctactaaaaatacaaaattgggctgggcgcggtggctcacatctgtaatcccagcactttgggaggccgaggcgggcggatcacgagatcaggagatcgagacaatcctggctaacacagtgaaaccccgtctctactaaaaatacaaaaaaattagccgggcatggtgttgggcgcctgtagtcccagctactcgggacgctgaggcaggagaacggtgagaacccaggaggcggagcttgcaatgagtcgagattgtgccactgcacaccaggctgagcgacagagcgagactccatctcaaaagaaaaaaaaaatacaaaattagccgggcatggtggtgcatgcctataatcccagctactcaggaggctgaggaaggagaattgcttgaacctgggaggcggaggtagcggtgagccgagattgcgccattgcactccagcctgggcaacaagagcaaaactccgtctcaaaaaaaaaaaaaaaaaaaaaagaaaagaaaagaaaaagaaaataaaataaagatttaatgggagaaaaaaagatttaaggcaaggatacccttagcttggcatgatggtatgggagcagttgggcccaaaagaactgctagtttaggtataaatgttctatctttttcacacatttgcaggggtgtgaaaa

SEQ ID NO: 1798 - DNA, 164001 bp, Homo sapiens
tatctctgactttttgatcgttctgcaatgttttgctctctatcttccagaccgctaatttggtctttaattctatttgcttctcaagccaacctagttaaccttttaagttcaatcaccacatttttaatgtccatgaactttcttgttctaaaagatcttttttcacaacaggctacttagattcactatacagcagctcaaatctctttgaagataccgactaacatgtttttggcttctgctatgcgccccaaagtctgcttactctgggctttttctttcatactatttattctcctcaaatgtctggtgatcctttgatgtgcattcacactttggaataaaagactgggccaatcaacaagggaaaccactgcatgcttccagtctggtattaacgctctcctggggaaggccagctacctgcaggctccgtgtaagaggacagaaagtgtccaatgatgggctttgctttaaggtatacaagtaaacaagcacggaggcagagtgggggacaaacaccaaatctgccaaaacagtctctcctccagtggcgaaggacgttcacagataccgcctgctagagggcctacatttccttcccaggacccctgttactgcaggagcccgcagggatctgacactctgctcggcttctctctcaggccccaacaccccctcaaggatccctccccagacacagttctcagtttttagccagagaccattgtataaatgtaatgcttcgatttcctaaatattactctagggccccttcctgttggtggttgttagtcactgtaaactcagcttttaatcccccccttttcttttgcacctgtgttttgagttacaattgttttgtttttgttttccttttgtcaatataatcccatctgttttcagtcttccaggaattcttcataacttttagtttaatagaggtaggcatcctttcaaattttctaatactattacagatgttttaaaatatttaccttttgttatttaaaaagatttttggcaagagagaagctggatgcatgtgttcagtctgccattttactcctaaaaatccagattgtcctcctgaatgcctaaatacttttttctaatttaaaatgctttattcaaagcaccctaaactagtacttcgctaggaaactgaaaaatattcctcttaattctgcttgctagtgaacagaacagactttaggcctcttgaattcattttaaaagtaactacagtccagttaaacaaggtaaggtccacaaaagaaaagacgtttaagcaacattttccaaagagagaaaaaaaaacacatatatgtaaggtttgatgagacaggcagtcctagaaaaacaaatggtacttcaccagatttcaaatgtaaagatttattcatttacaaggaatcaaaagtttgatccaataaaaaggcagttacaataaatctaaagccaatgaggattaagtttgattttttcaagcttgatttgatttctataaaagtataaaccccaaatatattgcttctacacattatatgcacatcagatgccaagtcaacgagtatttcataaatgtataacataaatatttaagaaagcaaaagagtataaagaaaagatgtggcctttgtcttttaaaaacagaaaatctgaataggaaaaaactatacacgtatctaaatctccacacagagataatgatagacgtagaagatggtgtcatgttacatcccactttttcagctcttacagaattgctacagtaattcacaagtatggtgagggagggagagtagctgaaacaggttgttgttgttgttgttgttttttatctgttattttaggttttactaatggaagtattgagactagaacaaaaagcacatactagatagatacttacctgaccaatcctggcaagaggactattgtctcactcacatggaattttaaaaatctgaaagtcttacataaaaatccaggtttccagtttgtcttgagtagtcagaaaagctgacaaatccagccccacattcctatgggaaatcatcagctggtgtgctggtaaacgttaacaactggctctctatagaagaaaaacaaaagcaaaagcccctgatctgtatagcatttgccatggtgtaaatacacccatcatggctgatttcaagctcccaacgtgatgcctggaaatgacaggcacaatcagctcatggacaacagtggccagagctgagtggtggctgccccttggacaggagttacgggccttccgtcctcactgctccctatagtcttacagtggctgctacctgcactggcaccagcccgccccacccctttctctctcttcacccccaagaattcctgagccagatccaagctggtggtagtgctgggcacaatgtcctcctaatcctcatcagaccacatggaaaaatcattgcttaggtaccacattttaggaggggcactgccaagcctgagtaggtaaagacagcaatgagctcagaagacatctccaacacaggatggctgacagcactggagatgttcacaccagatactgaccggggcagtgactctcaaagtggagagagaagagatgatgggtagggagaagtgcaccaaatgaaaaaaaaaaaaaaaaaagaactacttcatccaaaaattcttgactctgatatgttaaattcaattgcaaatgacattaaccatccacaacacttttatgtgtattaaaggaaaatatggatctctaaggattgtgaaacatttgtttaaaggaaacagtcaccctcctcaagtgtctaaacagctattcagtggaagaatctattttcagcatccattatgctaattaacaaggcatgttattttcaccagtggatatccaatttctaacatttattatgctaatttgatctgatataaaactataaaaatagcagagacactggtagtagctgtctctggagggcagcccttctgattaaaggccagatgtctagccctggatgcccccacttagagaatggcttaaataagcacctaatccacctgatgttttatgaagccttttgaattagaatagactactgggagatggtattttttgatgtcattgttcacaaaagggaagcaactgaaagcgccgacttttagaaagaacagaaacatcagtgcttattttaaacctaatgggagcttaggaacatggtccagtcagaggaggagcgctcccctgtggtgcctgaagcactcgactgtccacagctgccgacactcacctgggaactactgttctgatgatcccagcagcaacgcacaattcagtgcgccagcaccaaaggaggaaggaagacagaggtttgtttgggttggtttttttgagggggggtggggggatgtttattttactttaatcttgaattaggcatccaacttctcctaatttttattctcttaattttttctctgatacctcccccacccagtctactgcaaaggctcttgctataagaagtaatgaaaataggccaggcgcagggtctcatgcctgtaatcccagcactttgggaggctgagacagcggagttgcttgagcacaggagttcaagaccaacctgggtgacgtggtgacaccctgtctctaccaaaaatacaaaaaattagctgggtgtggtggtgtgtacctgtggtcccagctactcgagaggctgaggtgggaggatcacttgagccccagggggcggagcttgcagtgagccaagattgtgccactatactccagtctgggcaacagagcaagaccctgtctcaaaaaaaaaaaaagtaaatgaaaatgttttgtaaactacaaagtattatcaaatagaaatagtattccttggaatttgtacattattagtagcaacagtgatctttaaaatgagtcatttctgctagtgtttaataaattaattccttagagataagcctccctgcaggggctacttcattaccaataaatgtttactaaatgcccaccatatgcaccaaatggtagacgattggaatacaaaagcagaagggagcaggattctcgtcctcaacaggcaaggatctgctatagactcacaccatccttcaagtctggccaccctccccatgacactcccttctatgttgcctctgggttatcttgtctctaattaaacactttggcaaagtgggatctcgttacctggggaagcagcccttttcccctgaatcagttcctttccttcagttagctgaggtacttactgggaaagaaaactccatacatatgaaggggagtcctgtggcagcgtgcacctgagccatcacacacacaagagggcagagccatgaacgggggatgaaggactgtccccgagcacacgctaccacacgtcctgaacgtacggctggttacagctagttaatattttggaaatgctattttattggctaggaagccttttccaaatgaaaatctctttactgatagattagtgaaggtagtatagaggagttttattttgtttttgtttttttaatcagcagaaaagtctttcccgtcctctgggcagacagatagcagagaattacgcgcttaggtttcacagccaggctgcttccgttcaattctcagcactgccacaaccagctaagtgtacctgggcaaactacagaagccctataaacctcagtttccttatctataaaatgggactaattatagtacctacttaataggggtgttctgagaactgaatgagatgatactgtaatccttcaactgaggtccccagacaaatgctcaggagttcatgagaaatttttacttttgttatttcatggagaatcttttttaaaatttgacataagcatcctctgaatcagatggctaggtgctatgtcaccaagtattgctgtaagatttcagtgactatgtttgtatttttctggtctaatgaaaaaaggggtcaggcgcggtggctcatgcctgtaatcccagcactttgggaggccaaggcgggtagatcacttgaggttaggagttcaagaccaccctggccaacatggtgaaaccctgtctttactaaaaaatacaaaaattagctgggcatggtggccagtgcctataatcccagctactggggaggctgagtcaggagaattgcttgaatctgtagggcagaggttgcagtaagccaagattgtgccactgtactccagcctgggcaagagtgagacactgtctcaaaaaaaaaaaagaaaaaaggacagagacaaacccaatatataactgaggcatttgcactaagaaatagtcaaattatgtcaccacaacctgtatgatgaaaaattttacaagagtttgcaagatgaaagtggaggggaaattgcattagccggcaagtggcatgataggtagactaacattacagaaccaaatccggcagactggcagcatatgccacagttgtggaacagaggtttggttgcagcagatcttcatctgttgtgtcacggctagcttttattggctatatttagtttataaatgtgtattctagttatgaagttgtaaagaaactgcaagcataagggccaggcccatttttatgctttatatattcaagtaacataataaagataatcatattgtacttacgtaagggaatgttctcattcttttttttttttttttgaaatggagtctcactctgttgcccaggctggagtgcagtggtgcaatctcggctcactgcaacctctgcctcccaggttcaagcaattctctgcctcagcctcccgagtagctgggattacaggcgcctgccaccacagctggctaatttttgcatttttagtagagacggggtttcaccatcttggccaggctggtctcaaactcctgacctcatgatccacctgcctcagcctcccaaagtgctgggattacaggtgtgagccaccatgcccggcccaggaatgttctcattcttaagaaatgcacactgaattctttaggagtaaggaggaatgatactggccacttactctcatatagaaaaataatacccaactatatatacatacctatgtgtgtatatatatataaaacatgtaccaaaagacagagagaacatgtgcatgatgaaggaaataggggtagataaaaacaactggtgaatctggttaaaggacatgtggtagccaaagaactatagcttctcataactagaaggaatgcacttaaaagttcagatccagagttcccctaggaggatcattattagaccagtgattcgtgtggggaaagggacctgatgtcagatgcacctgggaaggctttgtcagaatgccagcaagtaccccgtctcctctctgaggatcgcggatagcagcgagccactcttatggatgaaaatgcacggcacacccctctggtattttaggatatgaaagtaaaaatcactgatgcagtgatcagataagcctccaaactatccgaaatgatcacagaaggaagtacttaatgaacactacagaagagctggcagaaaaacgatccaaaggccatgttatattgagcattatttttagacttaacttttctaaagtgcaactttacaaaaccaggagtcctcgaaatacatagagaaacagacagacataggcgacaaaacaacaactgcatttcccgtttgggctttcctgatgaaattctcccacagttgcacacacagttgctagaaagcaagagtacagtgctctttccctcactaagggaaaaccagactcaacaccaagactccaaggggaatgggcaggaatgacatcagtatgttgttctctttccagggcaccagaggacttggcactctgatcacaagtaaacacaactactccattagaggcagttcctccctattctaagcctttattattcctgggttttagagtcagtactccagaaaatggtcactccctttggtgaaacctatttgtctccctcctgtgctctggggcatgcctgcccctttgctgtaccatgcctcaatcgagtccaccttgtagatgctgatctactccggcatgtctgaatattaccggctccttttattttcatggcccacgtggcagtcagatcatcccagtgcatacaacggaggagccaggagtaaagtttatcacacgaaggagatgtaaaccaaatcatgttttttcaaactgtcggttccaatgtgttagtggatcctaaaatcaatgtaaggagccatgactcaacttctatttaaatagagtgcaaagaccagaaaagacacatcaaactgcactgtgcaaagtaagggtaaccattgtctcctctttttatttttttaaacatattttagagacagggtctcagtcgtcgcccaggctggagtgcggtggcaccatcacagttcactgcagcctagtactcccaggatcaggtgatcctcccacctctgcctcccgagtagctgggaccccgccgggtatgtgccacccatgcccacctaatttttaaattttttgtagagatggggtctcattttgttgcctacgctggtctcaaactcctgggctcaagtgaccatcccaccttggtctcccaaagtgctgggattagaggtgtaagccaccacctgagccagtactgtctcttaaaacttttggattggttatctcagtatatgtatatgaagatcacaatatgaaatggcttttttgagatggggtcttgctctgtggcccaggcctgagggcagtggcgcaatcacagctctctgcagcctttaactcctgggctcaagccatcctcctgcctcagcctctggagtagatgggactgtaggcacacaccaccacacccagctaattgtggtttttttttttttttggaggatgaggtcttcctatttttcccaggctagtctcaaactcctgggctcaagcaatcctccctcctcagcctgccaaagtgctggcattacaggcatgagccaccatgcccagcctaaaatgcttttttactgtgtgccacagtcaaccatattcaaaagccacagtattagatgctgagagaaaaggagagagaaagagacagaaagatcaggagtgggcccagctgaactagtcacaggagcaaaccccataagaggttcacttggctgatgcagaagccgaccagaagtcaccatgatcttgaggaaagaaatcataagagaaaagagtatatgagtgcaactaaacattacgttatcattaagctgacctggtttgctttcctttttttaaggcaaatgtagactacagcctagaaatataaacatattccatacaagagggccatgtgtccccattataataaaagcttgggttcttaggaatgcttacttgaaaggagtatggtaatcaatgcttcatcaattagtcaaccttcaataatcatctccaaacaaggagttagtgaatttcttggggcagatgcaaacgcaacccctgcaaaagctgctgtccttgccacatcactcacaccagccccatccagccttgctgatcatctgcatattcattcaaaagcactattccctccaccaaaaccctcaaagttttaatttaaagttattttaatctaagtgaggaagtcagcggatgcaattagatcttaaaattagaagatatggttaccaaacttaaccattttgtaaacattgcaataaaatggaatatcatgttaaagacatgccaaggtgttgttttatacattagcaccaagcaccttgccctcccattttcatcaatttaccctatgaagaaacagctggaggctggcacagtggctcacacctgtaatcctaggtgtgaggattattttgggaggccaaggcgggtggattgcctgagctcaggagtttgagaccagcttgggcaacatggtgaaacccctcctctactaaaatacaaaaaattagctgggcgtggtgacacacgcctgtagtcccagttactcaggaggctaaggcacaagaatcatttgaacccgggaggcagagattgcagtgagccgtgatcgcaccactgcattccagcctgggcgaatgagcaagactctgtctccagaaaaaaacagctggaaaaaagctgggacttcccagcaccagtattaccaatcactgaaaggagaggttcctcaagcacaaggaagaacagcaatctcaagttgtatttccattcagtaccttccagggttaccctagacactgattacatcaatgtctcatgagcagtggaatgattattttaagtaaatttatcccttccaggccatccagataagcaactattgtgttactacaaaaccaccattttactatttattttagctctacagtgtactattgaaatatttcttttattctccactagtagacatactgaagccttaatactatcaggtattatagactcaagtcataataggtactgttcccttcaaaatgctgaaacaataacatcctcaaaaatccccaagttttcagttctccaggagcaaaggaaaagagaatcatttaggtcaccttgatgagctgggaaactgatctcaagtagtagaacatttttctgtttgtaataagaggcccaaatcagattacattcacaaggcttttttaaagtgttgaggagaacgttaacctcccctaaagtctgagagcaatttacaacaaaagctaaaatagaattaatgtagggcagagaaagctgagtcaggctgaatcagcccaagtaagtctaagaaatccactgaaagacatcgaaacctaatgttcaactttgtctataaattgtatgacttttcacacacttacataataatacataactaatgaattaggtaacagaaaatacaatgcctggttttcgagctcagcatacttgagagtggtacacataacacaagagtaagaaaggtttcccaaaaatgttaataataattgaagacatctttggacttttttcctctcattcaaatgtaaaaaatgatcctaagaagctgaaaccatgatacagggattctagaattatgccagcccatctctaaagcaactggagtcatttgagtcaaaagaatgttcggctaggcatggtagctcacacctgtaatcacagcagtttgggaggccaaggcggatggactgctggaggccaggagtttgagaccagcctgggcaacatgatgaaaccccatctctacaaaaaaaagaaatagaaaaattagctaggtgtggtggcacacgcctgtaatctcagctactcaggaggctgaagcaggaggattacttgagcctgggaggcagaggttgcaatgagctgagatcatgctattgcactccagcctaagtgacagagcaagttctgtctcaaaaaaaaaaaggagaatgatctaggataaagtctacagtctattttctgattgttagagccttataagcgaatttatcctcattcttcaaaaacaccaatgggctgtgttcaacacagaaggaaagtaagagttcctctttcccttagcagtatcgttttgtttctccgaaaacagctctcccaaaccataggttccaaagggagtcttgcatctacattaccagctgtgcttgtccccacttctatacattttacagccataagcgtctgcacacaaacatattcatgagtcccatgaaggcaggaactgtcccttctttatctttatatgccccttatatataagggttcaatcatcactcactaaattggaaactaggtaggcctccaactggaacagaatgatcaaaagaggagacaagaaagtctttactctccccacttaaagacacaaaaggttaccctgaggtaattatttctatttttcattgtataaacagtattttgttttattattcctaactaaagttgggcattgtaaaagagagaaattcaaactactaccttatataaaaacttctaaactgactatattggcgctcaacaaagtctgcaaatagctattcaaatcagccacttctccagggtcgtcactgctccctacagtcttacagtggctgctccctgccctggcaccagcccgccccacccctttttctcccttcacccccaaaaactcctgagctagatccaagctggtggtaggcctgacacgatgtcctcctaatcctcatcagatcacatagaaaaatcattgcttaggtaccacattttaggaggggcactgccaagcctgggtaggtgaagacacagcaatgagctcagaagacatccccgacacaggatggctgacagctctggagagaggtgatatgcaattgtagaaagtcatatttcttgcaatcttagaggaataaaggagttttgttgttgtttaggtaaaaagccttcggcctgagctgcctctcccgagctccaattcctcagattcccatttaacatccttgaacttcaatttctttagtaaggaataattatacctcaccatcaggtggttatatcctcacaacaatcaaaagctaagtaagtgtgaattatacaagaggttgaaaaaaccttactagatacctcacgcaatcactggtagaatgatgatcttgtaggggtggtggcaggagggtgggaagacacagacgcatgatgataaggtttggatatttgtctcctccagatctcatgtaagaatgtgatccccaacgttggaagcaaggcctagtatgaggtgtttgggtcatgggggtggatccctcatgaatggcacggtgatgagtgagttctcactctactagttcactcaagagctggttgtttaacagagcctggcacctcttcctctttcttgcccttcctctcacatgtgacatgcctgctctccgtcaccttctgccaggagtaaaagctctctgaggcctctccagaagccaagcagacactcatgccatgcttgtacagcctacagcaccgtgagccaattaaacttcttttcttaataaatcacccagtctcaggtattcctttacaacaatgtaaatggactaagacacatgttaatacagaagactgggagaagccctatcagaagccaacaatgtgccaggagagagggcaaggcagtcccaaccaggagtcaaaagctaatcagtaagctcagtacacacgacagcccgttaatcctcatcaacactttgtaggtaggtattgttgctccatgttactaatgagaaaactgaggcttagaaaaataaaagtctaacagccagtagagaggtagacctcagattttaagaacatacacttgctgtctgccaatccaggaaggactaaactggaaagagctcatcttcgagaacttataatgtataaaacgtcaacctaaatttttttgttgttattaatattttagtgcttagaaaaagaactgttcctacatgaaacagtaattcttacaatattgtttagcaagtaatcttaactttgaacaagaacgtttaaaaataaatatattgttgggtgagcaggaaaatcactttaaaatgttgtagaataatcttccaatattgttcctttcacccatccctcaaactacactaatgaacattttttttctcccagtatttgctctttctcagcaatgcaaacataattttcatgactgttttccattatgacacatactgtacatttccaacgacataaatgacgttcgatgattttttttcccatctctagctctctgctggtcaattagtctatcaactaacacatatttatctcaacatctgagacacataaggagtatcttcattccagatcactgatagtaacctgagaaggaaagaacgacctacaattaacggttcaaactctagcatacaaagttaaaatactgattaaggccagacgtggcagctcccgtgtgtaatcccagaattttgggaggccgaggtagacggatcatttgaggtcaggagtttgagaccagcctggccaacatggtaaaaccccgcctctactaaaaatacaaaaaaaaaaaaaaaaaaaaaaaattagctgggcattgtggcaggcacctgtaatcccagctacttgggaggctgaggcagcagaatcacttgaacctgggaggtggaggttgcagtgagccgagattgcaccactgcaatccagtctgggtgacagagtgagactccatctcaaataaataaataaattaaattaaataccagttaaataccagtacccacacttgagtccacgagtttgaaaccagcctgggcaacacagcatgatcccatctcaaaaaaaaaaaaacaaaaaaaaaaacaaaccagtatccatagttaagtgccagttaaaagacttacatgttcttgaaaatacaaatgaggatgtgaagctgttatctctaaggaaaaccaccaaaattaacagcaaatagccagaaaaccatgtagagaagcatgtaattttgttatggagcagaagacaagggatcattaaagcacttaagctattttataatagactcctcacttacgtttttcgtcatcagcatgcaccagagatgctgccctggacaaaacatccaatggcgtctccattcctggttggagcctaagaggaaaaaataaaaggggaaaaaataatttaaacagaattcaaaagactcttagaatcctagtcattaacagaatgagtcctcaaccaaatgcaaatcattcttctaaggatgaaattcttcccacatgaggaaacagaatgggcttggttcagggagagagaaaagggttaaactccatttagtctactaagctaaactttgccaactacaggaagcagctgatgtaggaactaaaagaagggatattgtgaatattcatgcccatgttatttggtgcttatgtttatgtgcatgcataacatgcctgtataaacatgcccaataaaagaaaggttttcagaacaacggctgctctatgaacacagcatcactaccagtgaggtggtgcagcttaacacacgccacgtactcatggaaagctgtgtgagaaacccactggtaggttaattgatattttaagtccaataagaatctttatgttaaaacgtcatgttttgtataatggtatattatataatcaccacctatcatcaatttatctagcatcatgttttttaataagactggatttttattgttgtttccttaaattacagcatactataaaagctaaaacagcaaaagatttaaagctcgaggaaagccctggaaaaccagaatgctttttacccagtttcccttttctgggttatttaaacacacacacagttactggcacacacaccctactagctcaccagctgagaaaaacaactccttaactgtaccactttacagacacttggaatttattcagcattcttcaacacttatggagtacctactacgtatgcaccggtcacaacatgtggcagaccagcttttctttgtaatattcatacctcaggcctccaaagaaacactgatccacgaggcatggtagctcacgcctgtaatcccagcactttgggaggccaaggcgggcagatcacttgaggtcaggagttcaagactagcctggcgaacatggtgaaaccccatctctattaaaattacaaaaaattaggtcgggcgtggtggctcacgcctgtaatcccagcactttgggaggccgaggcgggcaggtaacctgaggtcgggagtttgagaccagcctgaacaacatggagaaaacccatctctactacaaatacaaaaaaattagccgggtatggtggcccatgcttgtaatcccagctactcaagaggctcaggcaggaagatcgcttgtacccgggaggcagaggttgcggtgagccgagatcgagccattgcactccagcctgggcaacaaaagggaaactccgtctcaaaaaaaaaaaaaaaaaaaaaagaaaaaaagaaaagaaaagaaagaaacatagatccctgatcatgcaatatgacttcattcagtaaacgttaaatatctacaaggagctccaggcgggaaaaataaacaaagcccagtagctgccttcgaggagctttcaatctgcacgggaggcaggccaccgagacatctagtttaaggcagcattcttccaaagcattctgcactgggtgttcatattttgtaagaaaaaaacgtttttctatggtaaataagtttgaggaagcctggagtaaaccaagctaagcagcgtattttcctccccgtgcctttaatctcccgttgtggggacagaaagccctgtacacgcgaaacctcgtagacgtcatgagccattttcaacccaaaacgcatctcagggaacatctggggaaaatactgggttagggcaaaatgtgcaaagcgtcaaaacagtgctagaaacaaagtcctacagaaataacagatgaattctgaaaggctttgtgaagaaaacagaacttgagcggaggctttgaagaacgaatataaaagttcctcccccagaagggaagaacagaagcagaatcggtttaacaacacgctgcccaaatcgcctacaagagtaaaatggggacagaaagtaagcgacaaggttggaaatttagattgggaccacatcgtgaaaggactgagggcttcgatgggaccgcggcttgacacgcattaaggagccactgaaaactccatctaagcagaaaagcggcttagtcatccatgcgttctgggcaagttatcctggccgcaccacgtggaacggagtagatagagctcgggaagctgagcgcagggcggacaacgggaaggccagagccgtgggcaagcacgcggagggcagcgaggggcactggcaccggagccgcggggaggcaggaaaacgcagaggcggagctcactgagcttggcaggcagagagaggaggggagggccacggaagactaagagtggcagggaggcaacgacctcctaacacacgcacatgtcttctttttcagagaggatgggtaaaagcagcggtctaagagggaaaacctaacagtgctcacattcctgatcttctttgtaaaaacagaaaagaccatctcctaagaggaaggatttgtgaacttgttcaacaatggagaaaaccaacaagaacttggaactgactaacagaaaaaagtctgctgaactcccaagaactaggtaatattctcttcacccaagccagcttcctattcaggaaagatctgggtttaaagtcttgtgatttggtcgagaccatcctggctaacacagtgaaaccccgtctctactaaaaacacaaaaaattagccaggcgcggtggcgggcaccgtagtcccagctactggggaggctgaggcaggagaatggcatgaacccgcgaggcggagcttgcagtgagctgagatcgcgccactgcactccagcctgggcgacagagcgagactccgtctcaaaaaaaaaaaaaaaaagatcttgtgatttggggtagtaactgctgataagcatcctactttgcaataatacagcatttagactcataattctctaaattaattttaccccattaagttgaaggacaatgctttcaaaattctagacctaaatagattaatacataccttaggttatataaagtatgcacagaaacaaaatatcaaagcataaaagtatcaaatgacataaggtagacccagaattctagcatagcggaatattagacatttaagtttatacagatgctatgaaatcctaaacccccaagcaacttacattcaaagtaggtagataagataatgggtattaaaggttcatccacaaggcacctgccatctgctgcaaccttattaatgaaatcaaccaatgtttattacacaattattctaagctcagcaaagtgcccagaaaaggttaaggagaaacagaagatagatctctgctttcaaggagtcacgctcttgttcggaaactaaattttataagataggataatgacaggcaaaatcaaaaagaggataaacaaagactaaatattatttaaaactaaaatgggtacagtgtcataaaagagatcaatgtcagctaacgtgtttgccttgtgcacatctattttttgtttgggggtggtttgtggatgcgtgtgtgtttcaaaaagccacttggaaaatttccttccccggttgccctgccccaggcagtcactctcctctctggcctccctcaccttcctggatcgcactgtgtttctgtatacttcctaggtgcaaggaccctgtcttatccccagtgcagtcatcctgagtcaacaacagtctgagaaaaggcacaggggcaggaatgagcacctgggacaggtggccagacctgactagctagaactgaaaatccacgttaggaagcagcagaagctaaattcaggtgagcctgatgcgggtggccttaggaaagagctgacagctggccttcaggttgatacttaatgtcacaggcaacaggcagttgtcatcatctgtccctgagctggcccgtgacatgatgttcacactattttagtttagaagttccatgcgtctaggcatgtggctcacgcctatagtcccagcactttaggaggctgaagcagaataattgcttgagctcagcagttggagaacagcctgggcaacatagtgagaccccatttctaaaaaaaaaaaaaaatttaaataaaaaatgagctggaagtggtggcatgggcctatggtcccagctactcagggagctgaggtgggaggatcacttgaccatggagggttgaggctgcagtgagccgtaattgcaccactgcactccagcctgggcaacagagccagaccctgcctcaaaaaaaaaaaaaaaaaaaaaaaaagacgaagaagttctgtgtaggatggtttgactggagagggtgactccagaagttactggaggtggatgagttaagaggcttctgtaggaagcaggtgcaagataaggacaatacagctgggacatgagggacggggaccaagcattatctagccatggaagaacaaagcaaaggtggaagataacagttattaaaaaaaaaaaaaatggtcttccaggtgggtgtggtggctcagccatgtaatcccagtgctctgagaggccaaggcaggaggatcgcttgagcccgggagttccagaccagcctgagcaacacagaaatttggaaatttactcatttctacaaaagattaaaaaattagccgggcatagggacgtatacctatagtcccagctactcgggaggctgaggtgggaggctcccttgaagccaggaggtcgatgctgcagtgagctatgatcacaccactgcactccagcctgagtgacagggtgagaccccatctgtaaaaaacaaacaaaaagtcttctgcattttatgtcttatatacatcctatccacagcactaaataaacccaataaaacatattgataatgtgggaggaaaaaccatggctacagtattagatggaggatcacaccacattgacaggcaaatcagcatcatgattatttcagcatcaaattagcatcaggattaatatgaatccaggtaaaccacttccaatctatgtaaccctgggaaatgacaacctctgtgtgtctatttcctcatctggaaaatggagatattaatattacctccctcatacggttttctgagaagtgaatgggccttataggtattgaaataattatttgccaaaacttatgcaaatatattgaataaatcacaaatgacagtaaatgtactgaaaatgacagggcactgtccactactttagctagcgtggtctgggaagatttcgctgaagagaagaatggaagttgagacctaaagaatgagaagaattagacccagaaagagcagggagggtgggaaaaggtgggagacagcagcacatgctgagaccaacacacaaaaaagctgggcaggtgatgtggggggcggccagggtggctgccctgaagtcagcaaaagggaggcctgaggtgggcagcacagggccaggtcacgtgtgcctggagggcctgcaacaccgatattttattttaagtccgtgaaaagtcctggaatggcccgaaaagcttcaagcaaggaagtgacaagtttattttatttcctttatgagccacaaattatcctctaccttacacaaaaaattatgctgcatctgaaaaacaaatctaggtctatcccaataatgtcttatttctgtggtagttttgcattaggatatagtgataaccaaaaataatccattgaggaccaggcatggtggctcacacctgtaatcccagcactttgggaggctgaggtgggcagatcacttgagggtgggggttcgagactagcctggacaacatggtgaaactcagtctctactaaaaacacaaaaactagccaggcatggtggtgatggcaccggtaatcccagctactcaggaggctgaggcagaactgcttgaacccgggagacgggggttgcagtgagccgagattgggaaagtgcactccagcctgggcaacagagtaagattccatctcaaaaataataataataataatccattgaaatgctgacacctggaacataacaacatttaagtgagtggagtgtggctctagaaaaagatacagagggccaggtgcagtggctcatgcctgtaatcccagtactttgggaggccaaggtgggcggatcacaaggtcaggagttcaagacgagcctggccaacatagagaaaccccgtctcttctaaaaatataagaaattagccaggcatggtagcaggcacctgtaatcccagctactcgggaggctgaggcaggagaatagcttgaacctgagaggcggaggttgcagtgagccgagattgcaccattgcactccagcccagggaacagtgcaagactccgtctaaaaaaaaaaaaaaaaaaaaaaaaacagatacaaagtacactgtgtgctccactgcactgcaaaccagtttctggtctatctattcacctttttcgtggttgtcaaatgtgaagttaattcatcatgaatagacatatattttgttgttgtggatttttttttttcaggtaatggtcatatattttctctgccagtccacatgcctttcctcacactcccttagcctcaattcatatgttcttccaaataactaaaggttgagaattagggaacaagaggtatcgattttaaagctacaaaaacttaggggcactcagtgctaacggcaagctcagctataaatctgacagccattttttggccttccacaaagaactgtccctttttagtcaacaaggggacatgagtacctatcttggtgtgttagtccattttgtgtcactataaagtaatacctgaggctgcgtaatttataagaaaagaggtttaactggctcacagtagactgtataagcatggtgccagcatctgctcagcttctggtgagacctcaggaagcttccaatcataatggaaggcaaagcagaagccagcacatgacatggcaagggcaggagcaaaagaggcaagaaggtgccacattcttttcaacaaccagatctcccatgaactaccagagaactcacgcatcaccaaggggatggcactaaaccattcatgagggatcgctcccatgatccaacctctcccaccaggacccacctccaacattgaggatcacatttccacataacatttggaggggacaaacatccaaaccaaatcacttgggaacagcactgtggggtatattagattatattgtttttcaagcaatggaacacaactccaaaatatgttatggaagttttccaagaagatttgcacaataaaagctacagcaccaggcatgttcactccatgtctgtcccatggcagtggctagatatgatatactttaggtaagagtacgagaacatggagcaactaccttgtctagatgtggaggccaggggggtgagcatcggaggaatcacattcaaactgccaggtgttcctgccacacacagtaacagggccaaaagtcagaaacagacagacatcactatccttaaacacctgatggcctctccaacttccagatgcacacaataaaataccctaattcctgttggccctgttccttcatgagtccaaactctggcctccccaggaccactccctgagctaaaaccaatttggtttcagctaataatatacaatggtaggacaaacccaaaagtatgaactatcacaccatggcatggggtgtacttcttggccatcaagaatttagagatgtggctgggcaccgtggctcatgcatataattccagcactttgagaggctgaggcaggcagatcacttgaggtcaggagttcgaaaccagtctggccaacatggtgaaaccccgtctctactaaaaatacaaaaattagctgggcgtggtggtgagcacctgtaatcccagctactcaggaggctgaggcaggagaatcactcgaacccgggaggcggagtttgcagtaagctgagatcgcaccatagcactcagcctgagcaacagagtgagactccatctcaaaaaaaaaaaagaatttagaggtggctgggcacaatggctcatgcctgtaattccagcactttgggaggccgaggtgggcagattacctgggcccaggagtttgagaccagcctgggcaacatggcaaaacctcatctcaacaaaaaatacaaaaattggccagtcgtggtggttcacccctgtaatcccagcactttgggaggctgaggcgggcagatcacaaggtaaggagatcgagaccatcccggctaacatggtgaaaccccatcccggctaacatggtgaaaccccatctcgactaaaagtacaaaaaattagccaggcatggtggcaggcacctgtggtcccagctactcgggaggctgaggaggcagaagaatggcgtgaacccgggaggcagagcttgcagtgagccgaggttgcgccactgcaccctagcctgggctccatctcaaaaaaaaaaaaaattagccaggtatggtggcgtatgcctgtagtcccagctacttgggaggctgaggcagaaggatggcttgagcccaggaagctgaagctgcaatgagctgagatcacgccactgtactccagcctgggtgacagagggagaccctgtctcaaaaaaaaaataaaaaagaatttagaggtatttactgggtatctcctctattaaaacactgtatttagacgttacaaaaaaggaaaagtaaactccctgcccttgagcaccgtacaccaaatatggatgatactgggtgatacactggctgtcaggctcagtgagaaggaaaactgaatgagaatcagaccaaatgtcaccagattctggtggcgacatgcaagcacagtttcacggttttaaatcctccagctctttctcctccccagagtgtccggtgatgccccaccaacttcgtgcagcacatattcttcctgttaacatcccattctcaaaccacccctctctgctcttcttgctaaaaatatctctcatttgagtaatccttttttcttctcgcactttaccatctgttaagtcaacagagccaggactttagcatcaggaagcccaagtttgagccctactttaaatctttcactcattcagtcaacaatccctgaaagcctattttgctctaggctttgccctagatgtctaacacttaattgtatgggccagtcatttaccctctccaggccctagtttcctccttaaagaaaaaagtaaaaaacattgcctaactaacttcctatgatcacaagcttatcacatagattaaacgatgtaactgagaatgtcttacaaactaaagagagaaacagattttattagtctaccaccaccatcttccaggtgtatagcatacatgttttcaaaatacattcacataaatgacctgattggattctcacaatcaaattattacttaggccaaatggccaaatatgattattatttttcttctacagattaaaaaaaaagaaaaattgaggcaccaagaatggaagtgacttcctgaagcaactaagactagaattcaagtctctcaattctccctccaatgctatttttactactcttaagttgatcatgctaaagaggttttagtgacaagcacaattatttagcctaggtcaaagcaaaccttccattagcaagcacgacttctagccctgtgctctttcctctacaccttgagatacctatcaggcaataatgtgaccgtttcaacagcgagcaaggggaagcaagcccttacccgtcaggaacacgcaaaccatggtatatttgaaattcttctaacagaggtaggcatggagtcacattaatagtaaccaaggcaggtaagaaaagaagactgtcacaccaggtcaattgatgctgagactgtggccaacaatgacaccggcaacaaactaccaagacatagcgatttctggggccacagccacagaggagtcaagctaaaaccctgaggactttgagatccacgaacaggtacagtagtaggaaggatggtgtcaacttcaccatgctcaggaagacctgtggtcaagctccaacggctaactgttaaggttcagtgagaacatttttaaaatttcaccttggtgctcgaactgctcacaaccttaaattgtatgttacctttctaaatagaagccagcccttattcaaaatattctctcaatagtcatattatcaaagaaagagcatgaccagacggatcatttgctattccagctttcctcacagaggcatgtcccaagcaggtataactgactcacgctgccgtaatttgaagcatcaatgccagaagaacttggctgcttctgcttgcgtcaaattccttacttctacacatgatcactcctgaaaattcattagaaggccaaacgttctaatatttgaacaatatatcttcatgttctatatctacctcctgagaactgtgtgtatatatattatttatatatatatatatatatatatctgcataaaatccctaattaggattttttcaggtacctgccaacctcaagtgtgagccccagatcacaccctttccataaggcttagcacccctcctgtgaaacctctgcaggagggaggtctacaggctgggcagctgtcaatctcttaccctccaatgtaggctggaggctgtatagcaggaacaggtaaccttaggtgcctccacctcccatgacctcaacagaaagtgagacccccattaactcagaccaaataaagggctaacactctggatggaaacactgaatgaatgctctgctcaaccactcaaggtttcctgatgctaacgtggctcagggcttgagtctataggacttctcagccctgcaggagggcaggggtacgatacttagtcatcacaactaccctggcaacaggagctagcagatagtgccaccacacagtgacaaaaatcctcggttattgtaatacagtttggtatcagtgtaaactatacaaatgcacagactgtatgaaagttgatcatgtacccggtgaggtacatctatacaggctctgggctgcaaaacccaacttacattacaacacatttcacggccctatgcaatgctgcctgatgctggtgcaaaattcttactgctggctgaagtccacccatctccctaaagtgtcccatggaaagtgactatatggtgggcccacactgaaactactgttatctaagggggacaaataaaaatcaagtctgaactttctgagcagactaccaattcccaacatttttcaacactgttgtcagcacaaataaaaatgaggccaggcacggtggctcacacctgtaatcccagcactttgggaggccaaggcaggtggatcgcttgaggccagaggttcgagtccagactggcctacatggtgaaatcccatttctactaaaaatacaaaaaataaaataaaataaataaataaaaatacaaaaaaaaaaagaaaaaaatgaaccatgtttttctttctcattttaggatattatgaatctctctctcttcattttcaagaccgcagccttatacagcaaggcatatgaaataacagaaactctttggcatttttagtttcctctggatatgcttgctcttgcatttatttgaagacttaaaatttgaatacttatgtgaatagttagtatttcctattcacaagtgctaaagcgacacatattcttagggacctattactcccaagaataaaagatgaatttgggctgggcgcagtggctcacgcctgtaaccccagcagtttgggaggctgaggcgggcggatcacgaggtcaggagatcgagaccatcctggctaacacagtgaaaccccgtctctattaaaaatacaaaaaattagccaggcacggtggcgggcgcctgtagtcccagctactcgagaggctgaggcaggagaatggcgtgaactcgggaggcggagcttgcagtgagccgagatcgcgccgctgcactccagcctgggtgacagagcgagactccgtctcaaaaaaaaaaaaaaaaaagatgaatttgcatcacagcccaagttagcaagcttcccagaacagcccaggtctaactctccatggttccaaaataaaatctcagccctcagcctattaaagccacataaagtcatctaattaatgacacagtgcaacattaggtagcactgtagttattaccatcagtaaatattattggttcttttttttattttttgagatggagccttgatctgtcgcctaggctggagtgcaatggtgcgatctcagctcactgcaacctccactttccgggttcaagcaattctcctgattcagcctccctagtagttgggatcacaggtgcccaccaccatgcccagctaatttttgtatttttagtagagacggggtttcaccatgttggccaggctggtctcaaactcctgacctcaggtgatccacctgcctcggcctcccaaagtgctgggattataggtgtgagccaccgggcccggcccagttcttgttattcatagtagttgtgttctgtaaaatctctgtgaacattgaattagtggatattgaaccagtgttcctaggggaaatgagagtgagattccttccggcttctggtcacatttttgcaaactgatcaatacacaaccttgttttacgtatgtttctgtttaaagacaccttatttaatacctattgttgattcattaatgttgaactcaaggccaacagcaccgtaactcaagcctgaatgaagctcatctaacatgtatattttctccatgaggctcatcacagccttcttggctgaggaacattagacagcattttagcaccatacttacgggccactgtaaatagcaaaatccccaataaaaagcacaaaaatgggcagggtgcagtggctcacacctgtaatcccagcactttgggaggccgaggcaggcagatcacgaggtcaggagttcaagaccagcttggccaacatggtgaagccccgtatctactaaaaatacaaaaattagccaggtgtggtggtgggtgcctgtaatcccagctactcgggaggctgaggcaggagaatcacttgaaaccggaaggtggaagttgcagtgagctgagatcgcgccactgcactccagcctgggcaacaagagtgaaactctgtctcaaaaaaaaaaaaaaaaaagcacaaaaatatataaaaacatgttactaaatagactgcaaaaagcacacttgtttacagcatgagagctcaaacaagaaggcagggtagtgccttgtctgagctctactgggaacatgtgcattgggaggctcaaatttttccccatactgcacatgtccacaaatgtcgaagaaagtgtcagaggcattgatttggggcttacaaataaattttagtgagtagacaaatttataaacatggaaccacgaaaaatgaggatcgactatatctggctattagacctgaggcatgagacacagaaagtacattctacaaagttttctctctttgcaaaagtgctattattctgtatttcaagaaggtataattgttctggttttagcacctcctacattccttttcctaccttggcagtttgtatctgccaaatcttgcatcaagattttgcaatctagttcttatgatactgggtttttttttgcgggggggtggtttatgtggacagatcctaaatgctacagattagcagcattcactttactcttctattaaacacccacccatagcttcattaactttaggtgagttccctgaaagaagcacaaatgagcctcagttaacatacctcgaagaaatttcttaactcacacacacaaaaaactttctctttcaccaggttctcatagctgcaacagctcatctcacacaagcaataagcagacacattggtatgttaaaatcaccacaccaaaacaagaaggcaataccctgccttcttgtttgagctctcatgctgtaaacaactgtgctttttgcagtctatttagtaacatgtttttatatatttttgtgctttttttttttttgagacggagtttcacaatttcagtgacgttaaaattttcccgtgtattttatttttccttcctgagcttacaacttttagtacttttgttaggtcatgttcaaagttacaaaacaacttttattgttaacctactcattattttactaaggcaaattaaaagctgcacagcaaaactctccaagacagatacctagaagagacacgaaataaactctccctttggatttgttttggcaaccaccagagactggtaacagggctgcctccataaggagttaagaggaatttcccactacagattttttttttttttttttttttttggtacagttgggagccgggagtctctctgttgtccaggctggtctggaactcctggcctcaagcgatcctcttatctcagcctcccaaagttctgggattacataggtgaaacaccgcgcccggcccagaacatttaaaagtgaaagtttttacataattatcatgtctgtaagaagtgttaaaatcttcagataaagtcataattttaaatcagttgggggatagcagtaacaactgtgtttatgtagctctttcaaagcttcaaagaatttataaataacacaaaatactttcaaagcacattattctctgtaattcctgaaactctgtgatgtattggaactaatattaccacccttttacaaaggaaaataagatacaaagtttgagtacgagtaacatttctggtcataaatctagtcagtgacactgataggactagaactcaagtctccagaaataataacccagagctgtttttactacaacattcacagttttggaatgtagtccatagttatttatagcagaattatcttcttaattgtattgtgttttggtcaacataaaaattagtttgcattcacttccaaatggaaagcaaaggcaggctgcccagaagtgtgaaaaaacggtggccggggaaattagcctgggattaaaattttgccaaagttaaacaacgaattgaagggtttacatcatttccaccgtgggggagatgacttttcaggccagatgtaacaggaaatacaagaaaaaattcaaaactgtcttgagtgtaagacaagaaacttctgaatcaagtatttctaaatcctttatttaaattgagagcattgggacttagagataataaataacttgtcccaagatcacaccacagggacagctttactgctccgaccccaaaggtctccttaaactgcccactctactccctcccagtcatgcgcagactcttcattagatgcaagcaggaaacaatgaacagtacaagtccgtggactcagcgagtagagaaagagttaaagtttggtatgctaacatggtatgcaaaactgaccttcaaatcctaataggcaaattaattttttttttgtctttgactatttagaggaaacaactgccagactccttctgagtagaggtaggcttgggtatagaacaagatattaaaactccacaaactgggagacagtgcctttcaaagagagggcaaccagctgttgataaaacccagcagaaccgcctccacttccccacacccctaccctcccgcgccaggctgctggttcttattaatcacagagaagggactacaactagcaaacatacagcaccgacgatcaaagtgaaaccgattttttaatcatctaacttaaacagacgaacacatgccagcaacgtacataaatacgaatagccccagcaagcactgtcttcataacctaagacagttaaatgtctcagggtgatgaatcaaaggagacttcaagcaaaacaaaaagcgaacagccctgtgctcttccgcgaggcctgcactgggtgcagggagagtgtgcagtcctgttttggggaccgggcaggaagcacaggaagagtacggtgccccttcccgcagtccacatcacagccctccctgaggccggcggggaccgcggggtgccaggcgcgggcctcctcgcccgccccgagcctccgactcccaggacgtcctccgggagcctaggcgcttccgctcccaccggcgcctcccgagcggcccggcaaggacccgccacctcctccctcccgcagggcatcccggttctgctccgacagcccaccccaaggcccctctcaggccagccctcgcccagcccgggtcccgccccgccgaccgggtcaaccgcactcaccgcccggcggctctgggcgcgcccgcctggggccggcctggccctgcgggggacccaggggcggggacgggacctgggcacgcggggcgcaccccgagggcgcgcagacgcacaggcgggctcgcgcccgagcccccgcacgggcccccgccaaacacgcacacgcacacgcacgcgcggaccgggccggcggacgggagcgcgggagcgcgaggaatccctggaatgaggcaccggccaacctgagccgggctccgccaggccagccaggccacgccctcggtcacgcccctcacggagcaggtgggggctgagccaggtgagccgggagggagataggggcgaggcctcccgcggcagggagaggccgctttccctcccccgccagctgcgcgcccggtgccagctcgcacctcccgggccgatgccggcgcgctggggcagtgaggtttgtcggggcgggcgctcccgagaggcgccagcgggcagggcgagtggacatggcgcacactgctgtggacacggcatctcgcacgcccccgcccccgaggccccgccaggggacacagcgccgtgcaaatgtacaaacacaaacgcacatttcgtgcgcgcccaggtgcccgccgcgctccccacgcgcgcacagtaggtccctgctcccgggggacagcgcacgggacgccgacgttcacagtccaaccagacccgtcccgcggacctgctgcccttcccgccacacacaccccgccaagcgcccggagttcagccgaacctgcggcacccacgccgccctccgcttcccccggctcgcgagcagccggataagggcgcaccacccgcccgcgccggttcgccgtccacacccgctcacccccggaacgcggcgcaccttccgtcccccgcctcccgggccccgtcgccccctctcggcacccgcatgcccgagccgcgctccccgacggccgacggccacgcacctgaagggacaggtcacaccggctgcgggaggggctgctcggcgccactgcgctcagaacggccgcggcggtcccgggcgctccgacgccgctgggtttcctcccattacagcatgttgcactccagcgctgcacttcacactcgcacacgcgcacacgcacacgcgcacaactccaggcgctcggcggcgtccttcccccgcctcgcccggaggaggaagtcctagtaaatcaaaacaggctgggagggagggagatcggagtggaaagagtccccttcagccgctcacacaccagtgtttgctgtgtttggcaaactcctggcgtccacaacccggactgctctgaaatgtgcccggggaggggcagggaggaggaggtaaaacgtttctaattggcgcaggttcttatattacagcagcagggcagacatgtgaccacgaaaagaaaaggcctgtctttaattttttcctgtctttctctggggatttggtggtggggggccgggggatagaggcctgatacccgccccccgccatccccagcaacccttgccctgttgttttcttgtactgccacaattaagaaaacatttgcttaacatatccagcggctaacttcataaaataaatagagactggacttcctctggtttgctttaaaaggcttcatgttgcttgccttctggctgttctcaaacctcagtcattattaggagcccctaccgtaagggctttccctgggagagggctctgctgaaagggaatgataacaatgaaaacaaataccagcttacattcgtgctggaaaaaaaaaatgctttgcagttttcaaactgttttcccatctgttgcctcatctgatcatatcaaggaacagcacggtgtctcactggatcttagcccctgttggatatgcaaagacaggtatgcgtagttccatgtttcagtgagattaaatggtttacctaaagcaggtggaggtgttgcccgaaacttggggccccttgtgaaatgtactctcctccagtccatacagggcctctggagatgggacaacccaacttacaagtcaacctaggaataggtcccctggctttcctgattcctggataaatattcacagattaaagctcggaaggttcccagtcttcccaaaggtactcttacatagactccgttttagtccatcagtagtctcggactaggaaaagagaaatcctgagaaagactgtaaataggagattcatcctgccaaactcagacagggaatgaggaaggaatgaggactgcctgggcagattccaggaaatatggtaagacagaaaaagggttttagattcagacagaatttgaatccaaactccgcctctatttgttataggatttggggcaagttatcaaacctcagttttctcatccgtaaaacagagataatgcttcttcgaagagccggtgtggggttacaggcttcgcagagacgtttaatgaatactcacatcttccttctcttctgacttaaatccagtccaggtgggcaccttatgaacagaggaaaatgaaatgcccagacaacgcaaatgaataatgataacaataatagtgcaactgcatatttataaaaatggcccaaggtttacaaagtgttcccacgtattattatctcatttgatctttatgacaacattgccatttgtttgctgctaaatgatttccattttgggtcagtgcggaggtcctaaagctgcctctttaatttccatcactgcttggagcgaaccttactctgcaaataaatcatggggacagaagaccttttctcatggatgtgaccagtcttcgacctttgcaaggattaatctcactctttgccttacatcagcattagcgtgacttagctctggcaacatctaagcctggtcgttttagtctggctcttttagttgtgcaaaggagagacacactcaagttactgtaagaaaaaggggggttgttgtaaaggtctagggggactggaagtggaacgtggcagacacatagaatattatacagtaacctaaattaaaatgacttacagtgacctcaacaatacagatgcatcttgacaatgttaactgaaaaaattaagtcccaaaagattacatacagcataatactctatttgtaatgttaaaaataaaattaaaaataattttagtggtacatatatctgcaataaaatgatataaaaaataagtcagggccagcctggccaacatggcaaagcccatctctagtaaaaatacaaaaaaaaaatggtcaggcgtggtggctcacacctgtaatcccagcactttgggaggccaaggtgggcgaatcacgaggtcaggagttcaagtccaggctggccaacatggtgaaaccccgtctctactaaaaatacaaaaattagccagatgtggtggcacgctgctataatcccagctactcagcaggctgagtcaggagaattgtttgaacccgggaggctgcagtgagccgagatcatgccattgcagtccagtctgggtgacagagtgagactccgtctcaaaacaaaaaattagctggggatggtggctcacacctgtagtcccagctactcaggaggctgaagcaggagaatcacttgaacccgggaggcagaggttgcagtgagttgagatgacaccactgtactccagcctaggcgacagagctgagtctcaaaaataaaataaaataaaaacaaaataaaataaaaattgaggggatgatgatgccaggattacctgggtgggggtgggggcaggcatgggattggatgggagaaaaccatttggttaaacattgttgtctaggtcctagcttggtaggttcacaggttctctattaaaataactacctaggccaggcgcagtggcttatgcctgtattcccagcactttggtaggccaaggcgggtgcattgctttagctcaggagtttgagaccagcctgggcaacaccgcgaaaccccatctctacaaaaaatccaaaaattagctgggcgtggtggcacatgcctgtaagtcccagctacttgggaggctgacatggtaggatcacctgagtccaggaagttgaggctacagtgatctgtgttgataccactacattccagcctgggtgacagagtgagaccctgtctcaaaaaaaaaaaaaaacaaaaacaaaaaaaaaacttaagtgatggttttacagtagtgtgaatgtacttaatgccatactgaactaaacacttcaaaatggttaaagtggtacattttgtattatgtatattttaccacaagtttaaaaaatgtataaggaacataactgggcaaatcaaaaagaaaacaatactgcttaagtagctaacaaataaaggtaggctgtacatagaccactgatgagaatatatttcaacccaaggattttataaatgcgccagaagtgtattttaaaaacaaaataatcaagggggtgactgagtggaggtagcaaagacacaagattggcccagagttgatcgttgttgaagctgaggatgggtacagaggagggtgttgaggtagcccctcagtgggggatgggggggggtgacactactctatctgctcttacatgtttggattgtttcatagcaaaagattttattttattttattttatttttatatttttatttatttatttatttattttttatttttgagatggagtctcactcttgcccaggctggagtgcagtggcatgatctcggctcactgcaacctccacctcccaggttcaagcgattctcctgcctcagcctcctgagtagctgggatcacaggcatgtgccaccatgcctggctaattttgtatttttagtagagatggggttttaccatgttacccaggctagtctcaaactcctgacctcaggtgatcaacctgcctcgggctcccaaagtgctgggattacaggcatgagccaccgcacctggcctattttttatttttatttttatttttattttgagacagagtctcgctctctcacccaggctggagtgcagtggcataatctcagctcactgcaacctccacctcctgggttcaagcaattctcctgcctcagcctcctgagtagctaaggtagcaggcgcctgccaccacgcccagctaagttttgtatttttagtagagacggggtttcgccatgttgaccaagttggtctcgaactcctgacctcaagtgatcctcagtcacctctgggtgattctccacttctgcctcccaatgtgctgggattacaggcatgagccaccgcacccagccctgtttcatagtaaaacattgtaaaaaggaaaatgaaaaaaaagtgcagagtaggaaggacgcgttgtggctgtgttgtgctctcacccatcgactgcacagcttctcagtttccctttcgctctgtttctttgtgcgtcctccccaatctagttctttctcatctctctgccaaggactttcctcacagctttggctcccttattgctatctctattaccccttttagcttttgcccccataggtaactgactccttccgtatcttcatagttcagattgctcagagaatctgattcttctctttcttcttcctgttcttcttcctcttcctctttttcctcttcttcctcttcctcttacacttcctcctcctgcccctcctccccctcctcttctcctctctcctcttctccttcctcttctcctccctccttgttctcttccctcttttgctccctcctccttctcctcctccttctcctccctctcctccttctccttctcctccccctcctccttctccttttcttcctccctcttctcctccttctccttcttctcctcctcctttttttcttctcctcctcctcctttttttcttctcctcctcctccttttttttcttcttctcctcctcctcttcctcctccttctttttcttcttcctcttcttcttcttcttcttctttcctcctcctcctcctcctcctcctcctccttcttcttcttctcattctgtcacccaggctggagtgaagtggtacaatctcagctcactgcagccttaacctcctaggctcaggtgattctcccacctcagcctcctgagtagctgggactacaggcatataccaccatgcccggctaactttttgtatttttagtagcgatggggtttcagtgagttgcacaggctggtcttgaactcctgggctcaagcaatcatcccacctcagcttcttaaagtgctgggactacaggcgtaagccaccatgcccagcctgactcttccctttccactaatccatagaaatgattgccggctgatctccctggaagccacacagccatgagggtcagtgaagtcaagcacagtccagtgatgagaaacatggtccatgtgggcgtggggtggaatggctttaagatggccacaaccaatgacacgtgtggaaggggctaaggagttcagttcatcagttaacaatttcttaaggctgttcaatgggtgagtgttataaaaaaagttttcccttccacgccaattgccaataagtagtttgtattccagtttgtcctcccatgtcatacttctaaggggcaaataaggggaatatcaacggctgccaatctgaattgctcgtagtacatatagacatctactgttcccctcattgcactaacctggctgtggaaaatgtgtttttctagtctatatccctttgcttatgatgtactttcatgaatctctcctgttttcttctcttcactccgacttgttccacaaaaagcactgaggaatctgaagatgtgggttctagttcacactcctctctaggtgacaaagtgagtcattctatacctctgcatattccaagtcttcccctctgtggggagctgagaccagatcaagttaggcaaacaggtttccttttgagcacctgctctgcctggagccctcttttgagaagggctctggcagcacagttgaggcttagtgacaaagtgtcgagattgattattaatgtatgctatgggcagggaataaaaatgagtgaacctggccgggtgcagtggctcatgcctgtaatcccggcactttgggaggctgaggtgggtggatcacttgaggtcaggagtttgagaccagcctgggccaacatggtgaaaccccgtctctactaaaagtacaaaaattagccaggtattgtggaatgtgcctgtaatcccagctacttgggaggctgaggcaggagaattgcttgaacctgggaggtggagtttgcagtgagttgagatcgcgctgctgcactccagcctggcagcctgggcgactctgtctcaaaaaaaaaaaaaaaaaagaaaaaagaaaagaaaagaatgagtgaagagtgaaccagatgtttgccatttttggtggaggagcgctaaaaatcccatctagtaataacttctttcttttctcatagtgtgagaacaggtgcatttctacttttctgggaaccaaagaactcagtggaaaaaccaaatgatcttatttcagggagagaggaaagaataagaaataatctaaaataataataataactaatgtttgaggagcactcactatgtttcaggcaccactctaagtgctttacaacaagtaccgaattttggcctcataacaattctattgtaaggtaggaactgtaggcatcctccttatgcacacaaagaaactgaaacatgcagacattaaattacttgtccaaggtcttaaagacagtaagaatgcaactagaattaaaccctggtggtccaattccggagtccacctgcttatgcccctcactcctcaggattgcctgcagactaattgcatccagcatcccctgagagcctgctagaaatgcaggcttgcaggacccacccagacctgctgaattggatctgcatttcagcaagcttcccaagtgactcatattcacagtgcactgagaagcaactgcttgcttacagatgttactattattattattatttcagacagggtcttgctctgttgcccagactgtggtgtagtggtgcaatctctgctcactgcagcctccaccgccagggcttcagtgatcctcacacctcagcctcctgaggagctgagactacaagcatgtgccaccacagtaggctaatttttgtatttttttctagagacaaagttttgccacgttgcccaggctggtctcaaacttctggactcaagtgatcctcccgccttggcctcccaaagtgctggattacagacataagccactgtacctggcctatttctttttttttctaatttaattttttttttttttttgagacagagtctagctctgttgcccaggctggagtgcaatggcgcgatctcggctcacagcaacctccgcctcccgggttcaagtgattctcctgcctcagcctcctgagtagctgggattacaggcatgcacctccacacctggctaatttttctgtttttagtagagacaagatttctccatgttggtcaggctggtctcaaactcccaacctcaggtgatccgcccaccttgacctcccaaagcgctgggattacaggcgtgagccaccgtgcccagcccctggcctatttcttataatcacatgtgaatctgcaactatttcaaaaaaaaagaaagtgaaattttatgtaggttttatttttcctgcttttgttgttgaggaaacagagctttgaagaagctaaataagcagcccacttggtaattcaacctatgtattgaggccccacctgctgtgtgtaagacactgctttccgcactgaatttccagcagtgaacaaatcttgccctcgttgagctatcattctagtgggtactcagttcaaacccacatctgggtgccaagtcctctactgctcagaaatatggtcacagattcagagagtagtaaataataaagctacacaaggttcaaatatttgcaaaatgtctgtacaagtatatatgaaagcattaacagtgctaggtacacagtaagcactcaataaaaattaatcctcttcctttctttcttgcagttgcctcagagcctggaaggaagctcatctccactgtgacccaactggatggggtccacgatgggcccattgtgagtagctgtgacctgagcttcatgcccctctggcgattagtcgaagagctgtgattgagggcgatgttccaaggtctggagatggacccttttaaacctgacagggaggccaggcacggtaactcacgcctgaaatcccagcactttgggaggccgaggcgggcggatcacctgaggtcgggagttcgagaccagcctggccaacatagtgaaaccccgtcgccactaaaaatacaaaaatagccaggtgtgatggcaggtgcctgtgatcccagctacttgagaggctgaggcaggagaatcgcttgaacccgggaggcgaaggttgcagtgagccgagatcgcgccattgcactccagcctgggagacaagagcaagactctgtctcaaaaaaaaaaaaaaatacaaaaacttgccagggagtcggtgatgtgtgttcctgtgaatgtcagttcttttcacagcatggttctgagaaagtgcccttaagcaagaccaaatttatggccagaaggattgctcagacccagacatctgagtggcatctaacactattctaaagattgactttgtcctcatgcaaggaattttcctttaaatactataagaacaattcaacatgcaatatattcttgctgtctttcctataaataaatttcactgggctgggacgggaaataaaagcctttttcaacacactaaaaaattgttgcagatgctggattcaaggccagtcagaatttggccgctgctgtcagacagagagtggtttgaatgaggaagcttaccgagaatgaatgtgtgttttcttctgtaggtggaatacaacaacaccccagagtgaaattcttccaactgggattgccctgttaccctgtctttttctttctttctttctttctttcttttctttctttcatttttttttttttttttttttttttttttttttttttatgagacagagtctcactccgttgcccaggctggagtccagtggtgccatctcggctcactgcaacctccacctcctggttcaagcgattctcctgcctcagcctccaaagtagctgggattacaggtgcatgccaccacacccggctaatttttgtatttttagtagagacagagtttcaccatgttgcccaaactggtctcgaactactgactgcaaggaaggaaggaaggaaggagggagggaaggagggaaggaaggagaaaggaaggacaaggttattgggtgccaagtgtgtgcagtgttgaacattctcatttaatgcagtgtgatcctatgaagaagattgtcccattatgcagatgagaaaacaggggctcagagagggtaggacatttgcacgggcagtgcaacactaggatgcaaaccagctggtcctacttctcattgaacaatctttcaataataccactaaattcacccagaaaagacctttggagaatctctaaataaataattgcatttggcagggcgcagtggctcaagcctataatcccagcactttggggcacgatggctcaagtttgtaatcccagcactttgagatgccgatgtgggtggatcatctgagatcaggagttcaagaccagcctgaccaacatggcaaaaccccatctctactaaaaatacaaaaattagccaggtgtggtggcacacacctgtattcccagctgctctggaggctgaggcagagaatagcttgaacctgggaggcaggatgcagtgagccaagatcacaccactgcactccagcctgggcgacagagcaatacttcatctcaaaaaaaaaaaaaaaagaaaaagaaaaaagaaattggctgggcgcggtggctcacgcctgtaatcccaacattttgggaggccaaggcaggtggatcacgaggtcaggagttcaagaccagcctggccagcatagtgaaaccccatctgtactaaaaatacaaaaaattagccgggcgtggcggtgggcgcctgtaatcccagctacttgggaggctgaggcaagagaatcacttgaacctgggaggcggaggttgcagtgagctgagatcacgccattgcactccagcctgggcgacagtgtgagactacatctcaaaaagaaaaagaaaaatgaaaaacaaaaagaaaaaaaattgtatctaccttcttacaaaaccgcttccattctgaagggaaacgtttcctcctggtttcccatcttctctgcaccaccacatggagctggaatttgctggggttcgaatgtgagcaccatgtttaccaaaggatgggaaacccctggcaaaggaaagttgctgatacgttggtattggacggacctgagttcaaacctgggtcctacctgctcaagcctctatttcctcacctatatgatggggatgactcctacttagaaaagtgtgtgtatgcgttagaacagccacataatcagtaaaagtgggtcccaggtcaaagtcatgtgagcccctactgcatgtagtgctgctggattacccagcaagcaggctatgtctgtatttagggcaccgcaatgtacaaaatgatttttgaaataatttgatatatataactaaatgaccagattagtcatcttgggtaaaatcagatcttgtttagactattttatagtttaatatccttctaaattacatatataaggagacatcatcctctttccaggacatagaagcgttaagaactcgaattctgcagggcatagtggcatgtccctgtagtcccagctacttgggaggctgagacaggaggatcatttgagcccaggaggttgaggctgcagtgagccgtgatggtgcccctgcattccagcctgggtgacggagaccctgtctctacaaaaattaataataataataaaagactcaaaaaagtgaagtgccctgctactttagaccaaaaagaaaccctctcctccttaaagcagtaagggaaatgggtttgggtcccaaataaatgagattttagtacagacgggggaaaaggagagcaaggatgtgtttgtttttatttccagggtgggagagaggctttccaaagactagcaagctgatgccccatggcagtggataatgtcatttctagatctttgaggctgctacaaaagccacagtgatgcccagtccagcttccacgtgtctcccctgcctgcccctcctctccccagggactttatgtgaatcctggggttgcactgtgaggggtctcaatctaattagggcatttttttttttttttgagatggagtctcactctgttgctcaggctgaagcacaatctcggctcactgcaaccgctgcctcctgggttcaagcaattctcatgcctcagcctcccaagtagctggtattacaagcatgcatcaccatgccgggctaatttttgtatttttagtggaggcgtggtttcgccatgttgcccagtctggtctcaaactcctgacctcaggtgatcctcctgccttgacctcccaaggtgctgggattacaggtgtgagccaccacacttggcccattagggcaattcttcttccttcctccatgtctccctttcttccttcctctatttcttcgttcatccttttgctctcttctttccctttttccttccttcctccctccctccctgccttcctccctttcttctttctttcctccctccctttttccctctctctctccctccctgccttccttccttctgtctagagcaccatctgtttgccatttacattctagatgttgatgttacaactgtcagtaagacaagcaaggtttcactctcatggagcttctcctctaacacggaggtgttggggaagaggtggggagagagatcattagccaggaaacataatttaagtcatgtaagttaacataaaagagatcattcgaaatagtgaaaaaagaccgtttaaaataatggcaagtgctatgaagaaaataaaacagagcaatgaaatacagggtgacgggttgtgacagcagaatagcatcactccagtagggtgatcaaggagggcctctctgaggaggtgacatttgagctgaggcctgaatgatgacaaggagacagccgtgccacaatctaggggaaaaagatttccaggcagaaagaatagcaagcacaaagactctgggacaggaacacagtcaccatgatggaaggatggaaggaaggcctgggtggctggaccataggaaataggggttggggggacaaattcaagaaaaacctgggaagtggtctggctgtggtaaggagctctgactttattctacatgccaagggaagccacttgagggagtttagggattagggtaatatgatttgagttttttttttgtttgtttgtttgttttgagatggagtcttgctctgtcatctaggctggagtgcagtggtacgatcttggctcactgcaacctccacctcctgggttcaggcatttctcctgccacagcctccggagtagctgggactacaggcgcctgccaccatgcccggctaatttttgtatttttggtataggcagggtttcaccatattggccaggctggtcttgaactcctgacctcaaatgatctgcccaccttggcctcccaaagtgctgggattacagccatgagccaccgcaccaagcctgtgtgagttcttaaaagagctctctgatggctgtgtggagaatagactgtcggtggggcacagatagatgcctgaggccttttacccttctgcagggacctggctgaggcataatgctagtaacagctattcatctggaagggggtgttgcatgactcagcatccaggccttataaggagtttgggggtgtcctgagatttttttttttttgagacggagtctcgctctgtcacccaggctggagtgcagtggcaccatctcggctcactgcaaactctgcctcccgggttcatgccattctcctgcctcagcctcctgagtagctgggactacaggtgcccgccaccacaccgggctcattttttttcgtatttttagtagagacggggtttcaccatgttagccaggatggtctcgatctcctgacctcgtgatgcatccgcctcggcctcctaaagtgctaggattacaggcgtgagccaccacgcccggccaggggggtcctgagatttttaaattttcgtttccaagtccaaacaggtattctggaagaacaaatggctctcctccaagtagtgactcagggacccaagatccttctatcttgtgcctctgccagcctctggggccccagagttcattgcatgaccctctttagccagcaagcagatggagaaagagcatggagaaggcacacgtccttcctcattatgtgggccagcacacaacactttatattccattggtgagaaccagtcacatggcctcactgaatgaagacgggctaggaaatgtagttccggggtgggcagccacttcccatcaccggctctgtgcaaagagaacccgggcctttggtggccagctggtcatctctgtcagcaaaccttctgggaggaatgcgaggcacccgggatgacaagttggcttttggcctgagaagagatgaaaggtgatccttaaccaaaatgggaagctgggggaggagtagaattatccttggggcagaaccaagagttccattttgcacgtagtgtgagctgtctgagagacatctgaaaggagacattgggagggaaactggatatatgaaacgggcacagaggtggcgtccagactgaagacttaaatgtgcattttccccttcacccagtggcttctgatcctgacagctcctcttacagtcatatgggcccttcactgcctttgaccctgagtgcactaattacactggtgtaattcactcctctattagaaagaatgtttgtaattctcttactcactaaatgatagctctattacatgcagctactcattcaacacatagttcattgagtgtctactatgtgctgggcactcatgattagcagggaagaagatctagtctctgcctaatgaagactgcattctagtaggaaaagacagataataaacaaattaaaaagcaaatatggaccgggcacggtggctcacgcctgtaatcccagcactttgagaggccgaggcgggtggatcacaaggtcaggagatcaagaccatgctggctaacacggtgaaaccccgtctctactaaaatacaaaaaaaaaaaaaaaaaaaaattagccaggtgtggtggcgggcgcctgtcgtcccagctattcggggggctgaggcaggagaattgcctgaacccgggaggcggagcttgcagtgagccaaaatcacgccactgcactccagcctgggcaacagagcgagactctgtctcaaaaaaaaaaaaaacaaaaagcaaatgtgactcaggcatggtggctcacacctataatcctagcactttgggaggctgagaagggaggatcacttgagccaggagttcaagaccagctgggcaacaaagtgagaccctgtctctacaaaaaataaaataatcagccaggcatggtggtgcatgcctgtagtcccagctactctggaggctgcagcaggaggatcacttgagcccaggaatttgaggctgcagtgagttacgactgcgccactgcattccagcctgggtgacagagtgagatcttgtctctgaaaaaaattttaaaattcttttaaaaagtaaatatgggctgaggcaggcagatcacttgagctcaggagtttgagaccaacctgggcaacatgacgaaaccccatccctacaaaaagtacaaaaattagccaggtgtggtggcgggcacctatagtcccagctacttgggggtgctgaggcgggaggatcacttgagcttgggaggtggagactgcagtgagctgtgttcatgtcattgcactccagcctgggtaacaaagtgataccttatttcaaaaaggaaacaaaaaagaaagtaaatatgtagtgaatcaggtgccctagagaataatggagaaagtgcctgggaagtcaagggtaggattagtagaaacagaaagacttctataataaggcaacatttgagcaggaacgtgaaggaagttgagggagcaaagcacgtgtatataatgagggaagaatgtgatgtgccaggcgagggcgcagcaggtgcacaggctcagaggtaggggagtacccagcatgtttccaaaccacgcagggcccagcgtggctgcagtggggttggaatgagagattcaaatggggttaggggttgagatcagagaggcagggggtgaatagatcatgcagtagccaaagcaaaggggttttctccaacaccttcatgtaactggagaagggagaaaaacaaacctatttcctcgtgcagaaatctctccaaagagagcaatgtacaatatcaggaacttcctgtgtagtttccaaaatgaaacaccttcaaagtggaggatttgcagcccaaataagaaagggtaaccgtctcataatgtggagtacagaatacaccatctctcctcgtgcagcagttttcttcacagttaattgcagccacatgtgcccatggaaaggaagcatttttagcaagtactatcagagacctgggcaggcgcttcccatccctcatgctcagagcaaaaccaatcatgtgattagctcaggaggatgggaatgtaacagtgctataatgataaatactctgttttctgaatttcaattccaaaatctgagcaagatgccttttattagcttgttttgataaatgtcagaagcagcaggtttaaatcaaggaagacacagtttctcatggtttctgttaggttaccttgggcagttcctcctgataggcccactgtagtgagggtcatgaaacaaaaataccaaggatggcgtctgggtcttttatcgctgctcttgatcacagcggggcctcagcgcaccctgcttcagcaattaccacaaacgtgtgggcaggacttcagagtggctgctcgccagtttatctcatttaatgctggcatccctgggactggtcccattttctgttctatacaagagggtatagagtgaatattggtgtgagtttggctcccaagtgtctggccactcttcctatttaggggaaattcttctgtagacttggtctacagaagccaaagggagctggataatccctccctggggctaagacacaggctcagccaactggatgcacctgcccaggaccagaactcttcaggggatgattcgaaggcttggtggtggcaacatcaagagtccaggaatggcagtgcccaggctgcagtgcagggagagtcaggagtccgtctgcaccagatggctcccggggcagccctggccaccttctctagctcctgaccactttctcggactgattctccagccttcccatctgttcttcagccacccaacacccagccagtgggctccgtttctgcttaccttaaccagagaccactcctgttgtctataacccagaaccctggcttaatcttaagtaatttccagacacccacccccacctgccccccgcattaaagaacagaaattcctgttggcttacattattattattattattattattattattattattattatcattattattttgagacagagtttcactcttgttgcccaggctggagtgcaatggcacgatctcggctcactgcatcctccgcctcccaggttcaagcgattctccttcctcagcctccagagtagctgggattacaggcacccaccaccacgcccagctaattttgtatttttagtagagatggggtttctccatgttggtcaggttggtctcgaactcctgacctcaggtgatccgcccgccttggcctcccaaagtgctgggattacaggtgtgagccaccatgcccagccagcttacattatttttgttatcatgtaactcaaatatgtatatcatcaaactaaatataaactccttagaggcttgtagcttttaagcagctataaaacacaaacacatttgcaggcaaaacacaagcaataccacaaagtcagcaaagttgaaattaacaatattaacttgacatgacagatgatacgattttgtgaaactaaatagctgttccaaatggagatatggagctgactggtcgctgggctcctgtggttttcttattgccatgggccgtttgacaacgtaactcttccacttttcttctccattcaaaccactgtgcacacttcattcacaccacacgttactcacaaatgaaaactgctgctgctcttatgtcatttagctaggacaattaaaattgttccaggtggccccaatgccactgtaaacacaaaggcaaaagcagagcttgaaattagatgaaaaggtcgttcagatgagccacgacttgaacatgtccatttttaaaagaacatcaaaaatattaactttttaaacatctcatagaaaaccataaattcctaagagtacctttgtaaactccagtttcagaaatcatgagaaagtaattaggagcataagccgtggagttaaaaaaagaaaatcctggttttgaatcccaactcaacccctttgctcgtcttagaaccttgaacaagttattgagtatctctgagccttaattttcttacctgtgaaatggaacaataatacccatcttttaggaaagttgtattaaacaagatgatgtgtgtaactggtcaatacatggtgctagttattgttcccgatgtcctattcaactttcaaattggctaatgtttttgcctggttcatacagccagctggccacagagacagcgctggaaccagagctctaagccctggcccttaggagtacccaccgaccttttagggctgtgctcagagggagttgctgtatccgaggggtttatactctgtagacaatcactccattcctgggtaattctgtggatgatcctccccaaaaaatgaatcccactttcccctacttgacaacttctgtccatcccctattcctcatacctgtggttctcacagtggggtttcctgaccagcaggagacatggcagaaacgcaaatgcagattctcaggcctcgtcccacacatactcagtgggtggtggcacccagcagcctgtgtttcagcaaactcccgcttgaccctgatgcaggctgaagtttgagaattactgcattctaggaccaagtccaagttcttagcacagcatccagtgctgcctgttctgggcccagcccaccttttggccccttcacccatcactcctgaaagcaccttccactccagcgacattagactctactctctcatgtctccaacatgacaagcccttttgtgcctctatgctttggtgtatgcagggcagttccctctactgggcatttcttcaaaaggtctccttctctttgaacccttccctgattgcttaaggctgaatctgtggctctccaacttttctgtcaccttctattactaccacagttaccaggctgtactgtcaccagagttacattcttgcctcctcccctagatgataaggtcctcgtgtttgcagcagctagtgaccaatccatatccactctccccttgccctaatcagagaatctggatttcccagctcccttgcagacaggagtagtcaaatgactaagttctgggcaatgagatgtgagcagaagctgatggctccagctcccaggggctggctcttccctcctgcctccttacagtgagtgggcatgctgtggccatcttgcaaccatgcagtgaacttaaggatagaagatgcgttaagggctgggtgcggtggctcactccgataatcccagctactcgggtggccgaggagggagaattgcttggacccgggaggtggaggttgcagtgagccaagataacaccactgcactccagcctgggcaacagaacaagactccatctcaaaaaaaaaaaaaaaaaaaaaaaaaagagacatgttaaggatggagcaaaaagatgagtgaggatactggatattcaggatgttgtatgctcactgcaccaactctggacctttatccccagactacaggttcccagagactcaaataaattcctttcttattggagccattgtttctttcccccggcttccaacaacgcagtctcaggggcaagactgtgttttattcactgcagaatccagtgcctggcacagagcctgactcagagcagatgcttcacgcatgtttttggaaggaaggaaagaatgaatccttccttattatttctgttacaagaggaatcagagctcatgtattgggcctaaaattacttttttggagactctggaaaaccacataaggcaaaaaacaaaacaaaacaaaaaaaacaccccagatcttttacattttattttaaattaaaatgtcatagttttaacttagaccagaataatattatcccaccattggacagaaaataggtgttaaatgaagatgcgtgtcattactgctgaaaatccctcaatagttgctcacagcccttaaaataaagtcccaaatccctagtgttttctggcttctcactgctttttctttctttttttaagtggatataattgcagattcataggtgtttataacagatgatacagaggggtcccatgtatcctctgtatcatttgccccaatggaaacatcttgcacaactctggtgcaacatcacaagcaggatattgccattgacacaatccaccaatcttggttttccccagttttacttgaattcatgtatgtgtatatgcatatttgtgcatgtgtgtgtcctagtccttttgtgctgctatgacaaaataccttagattggtaatttctttttcttttttttttgagacggagttttgctcttgttgcccaggctagagtgcaatggtgtgatcttggctcaccacaacctccgcctcctgggttcaagcctcccgagtagctgggattaggggcgcccgccaccgcgcccggctgatttttgtatttttagtagagacagggttgcaccatgttggccaggctggtctcgaactcctgacctcaggtgatccggctgtcttggccttccaaagtgctgggattacaggcgtgacgactgttcccagcctgaccggtaatttctaaggaacacaaattcatttcttacagttttggaggctgaagtcaaatatcagggctccaggccgggcgtggtggctcacgcctgtaatcccagcactttgggaggctgaggtggatggattacgaggtcaggagttcgagaccagcctggccaacatggtgaaaccccgcctctactaaaaatacaaaaattagccaggcatggtggcgcatgcctgtaatctcagctactcgggaggctgaggcaggagaatagcttgaacctgggaggcagaggttgcagtgagctgagatcacaccattgcactccagccaggtacagaacaagacaccgtctcaaaaaaaaaaaaaaaaaaaaaaatcagggctctggcactggtgtctggtgtgggctactgtttccaagatggtgccctgttgctgcgtccccacacagcagaaggtggaaggacaagagagctgaattcactcctttaagcacgaccacaagggcactgaatcccattcatgaaagtggactcctcatgactcagtcacctcctaaagtccccacctcttaataccatcaccttggggactaagttatccccttatcctcagagaatacatcccaagacccccagaggatgcctgaaaccatggcaatcagaacacatttctcttcatgtcttccacccactaactaagcacttatcattcacagtggccataacttttgcggtttgaagtgcaacagcaaaaccagcacaaatttctttttccttgtccccagtttcatggggagaaaatttgtttttaccatagatcttggcaacttcagcatatgatttttttgttctttctttcttatgttgggaactttcaccttgtcacttaagtggcttctctttggactatcccaattgccagcgtcgctactctggtgcttaaggtcgttattaagtaaaataagggttactggaacacaagcactgggatacctgacagtcaattggataacccagatggctgctagatggctaatgggcagggagcgtctgcagcatggatatgctggacaaagggattattcacgtcctgagcagaacggcacaaaattccatcatgctgctcagaacagcaatcggtttaaagggtatgggattttccatttaatattgaccttggcaaataaataagggggtctaccgtatgcattttagaggaacacacacatttagaccctaagagtgcatgtgtgtatttagttcatgtgtgtaggcccatatatccaattccacagtcaagactcagaacatttccatcaccacaaaaatcccttggggtgttcctttgtaaccccactcccctcccctcccactgtgccctctctcctcatcccagacccctgacgaccaccaatctgttttccattcctaaattgttgccatttcaaaatgttatatgagtggaatcatacagtatgcaaccttataggactggcttctttagcttggcctaattccttgaagattcatcccagttgttacatgcatcagtaggcctttccttttgtcgcggaggaatcctccatgggatggaagaaccacagtttgtttaaccactcacgtgctcacagacaccggcaccatttccacttgctggctgctgcaaatcaagctgctatgaacatttgtgtataagcttttatgtgaacatgcccatcgcttgcttttttttttttttttcctgagacagggtcttgccctgttatgctggagggcagtggcatgatcatagttcactgcagcctttaactcctggactgaagcaatcatcctacctcagtctcctgaatagcggggactacaggtgtgcaccaccacacctggctaattaaaacaattttttttttttggtagagacaggggtctcgccatgttgtccaggctggtctcgaactccaggactcaagcgatcttcctgccttggcctcccaaagtgctgggattgcaggcatgagccactgtgctcagcgacccagtgctttttgaaccccttcctatgactggggagctctctcccttataaatgctgcctactaaagactaaagccagaaaaactcattttcccaacttctcttacatctggggagtgtaggcccccccaaccagacacagccacgcaagattttacgcagaagtgagcagtgtgaggaagcaggcactccaaagaatccatctgaagacaaggatgagagcagaggccaccaaaaacttttggggatcagcaataatggaggtttgcgtgtccatgtcgctgaagccagtgagcttcggggtctataccagcagagtggtggcagtggagtctttgctgaaagtcctgtggggtggtttgggcattgtttctggtcccatggtcctccaaaccccattctctggccctttcagagatgtaaactacctaataatctcttttttttttttttttaagaggaagtctcgctctgttgcccaggctggagtgcagtcgcacaatcttagctcactacaacctctgcctccagggttcaaatgattcttgtgcctcagcctcccaattagctgggattataggcacccaccaccatgccgggtcaatttttgtatttttagcggagacgggtttcaccatgttggccaggctggtctcgaactcctgacatcaagtgatccacctgcctcgacctctcaaagtactgggattacaggcgtgagccaccctgcctggcccctaataatcttctgtaaatttattttctgcttatataagttggagtggattctgttgttcacagctgagagctctaaccagcctccctctgtcgcctcacttctggccactcttaccctcagtgctcccactatacagcagcgctttcagtttcccggaggtaccttagggcatcaggtgcttcccgtggcacagtggagcctcttcacttacctgcctccctcatggaactgcagacctagtatccccagcctctgtcacccttccattgccctcagtatatgctcaatccatgcccaaatgaaccaatcgctcatctttatcattgatgagataagaacaagccagtacaaccatagccagtgctattatggttgccttctcactctgcactacagtcccctcatctataaatggagtaacacttaaaattttttattttttattttttgagatggagtttttgctgtattgcccaggttggagtgcaatggtgtgatctcggctcactgcaacctccgcctcctgggttcaagtgattctcctgcttcagcctctcaagtaactgggattataggtgcccaccaccatgcccagctagtttttgtatttttagtagagatgggatttccccatgttggccaagctggtctcgaactcctgacctcaggtgatccacccatctcggcctcccaaagagctaggattacaggtgtgagccaccatgcccggccaagaataacacttctaagagaagcacggtttaaaagttaatggcagccgggcacagtggctcacacctgtaatccctgcactttgtgggggccaaggctggtggatcacaggatgtcaggagtttgagaccagcctggccaacatggtgaaaccccatttctactaaaaaaagaaaaattagccaggcatggtggcacgcacctgtaaccgcagctactcaggaggttaaggtatgagattcacttaaacccaggaggtggaggttgcagtgagctgagatcctgccactgcactccagcctaggcgacagagcaagactttgtctcagaaaaaaaagaaaagaaaagaaacagaaataaaagggaaacagaaaatagattgggcatggtggctcactcctgtaatcccaacacttcaggaggccaaggcaagaggattccttgagcccagaagttcaagaccagactgagcaacactgcaagacctcatctctacaggtaattttttttttttgagatggagtcttgctctgttgcccaggctggagtatagtggtgcgatctcgactcactgcaacctccacctcccaggttcaagcgattctcccgcctcagccgcctgagtacctgggattacaggtgcccaccaccacactcggttaattttgtatttttagtagagatggggttgcaccatgttggtcaggctggtctccaactcctgaactcaggtgatctgcctgcctcagcctgccaaagtgctgggattacaggcatgagccaccacacccggcctacaaataattttttaaaattagccaggtgtggtggtgcacacctgtagtcccagctacttgggaggctgaggctagaggatcacttgagcacaggaggcctagggtgcagtgagccgtgatcgtgccactgcactccaacttggacaacagagtgagaccttgtctcaaaaaataaatcaataaaaggggaactcaaagagatattagtatatccatgctcatagaagcattattcacaatagccaaaaggtggaagcaaagcaaatgcgcattgataaatgaatggataaaaaaactgatctatgcataccacggaatattattctatcttaaaaaggaagcgaattctgacacatgctacaacatggatgaaccttgaggacattatgctaagtgaaataaactagtcacaaaaaaaccaaatactgtatatttccacatctatgaggtacctagagtagtcaaattcatagagacagaaagtagaatagtggttgccaggagctgtgggaagaggaaatgggaagttatcatttaatgggtacagagtttcagatttgcaagatgaagaaagatctgtggatacatggtggtgatacgggcatagctgtgtgaatgtatttaatgccactgaactgtacactgaaaaatgatcaagatgctaaatttgaagttatacctattttatcagaattttttaaacattagtggtaaactacagttaattaccacttcatattcactgaaatggctaaaagtaaaaaagcctgacaataccaagtgttggcaaagatctgaagaaattggaactctcatataccgtttggcactttttataaacatttaaaaatttaggccgggcgcggtcgctcacgcctgtaatccaagcactttgggaggccgaggcaggtggatcacgaggtcaggagatcgagaccatcctggctaacacagtgaaaccccgtctctactaaaaatacaaaaaaattagtcaggagtggtggtgggcacctgtagtcccagctacgctgaaggctgaggcaggaggagaatggcttgaacccaggaggcggagcttgcagtgagccgagatcgcaccactgcactccagcctgggcgacagagtgagactctctcaaaaaaaaaaaaaaaaaaaatttaaacatgcacttaccatatgacgccagaagtgtacagtgagctgtttacccaagagaaatgtaatgttactagaagacttgtgcacaaatgtcagagcagctttaccaataagagccaaaagctgaaaataagttaaatgtccatcaacagatggacatcaagagataaacaaattggggaatattcctgcaatgaaatactactgagcaataaaagaactactgatatacacaacatgggtgaatcttagaaacattatgctgggggaaaaaaaacatatatcagaggctatatattctaggattgctatttattattaattaatttatttatttatttttaaggcagagtctctctctattgctcatgttggagtgcagtggtacaatcacagctcactgcagcctcaaatgatcctcctgcctcagcctcccgagtagccgggactacaggtgcacatcaccatgcccagctaattttttgtattttttgtagagacagggtctcagtatgttgcctaggctgctctcaaacccctgggctcaaatgatcctcctgcctcgacctcccaatgcactgggattataggcatgagccactatgccagacccatgctgtatgattccatctatatctagaaattctagaaaagacaaatctaatctgtggtgatagatattagatcagtggttacctggaatagggcttaggagagaaagactacaaagacgtgtggtagaactttatttatttataagacggagcctccttctgtcacccaggctggagtgtagtggtgtaatctcggctcactgtagcctctgcttcccaggtcccagcaattctcctgcctcagcctcccgagtagctgggactacaggcgcacgccaccatgcctggctaatttttgtatttttagtagagacggggtttcgccatgttggccagctggtctccaactcctgaactcagatggtccacccaccttggcctcccaacgtgctgggattacaggcatgagccaccatgcccggccagtgtgatggaactttctagactggtagaaataatttatatattgattggtggttacataggcatatgtgattgtcaaaagcctttgaactgcacacttaaaatatatctaaattatacttcaaagatggggcacggtgactcacacctgtaatcccagaacttcaggaggccgaggtgggatgattgcttgagcccaggagttcaagacccctgggcaatatagcgagactccatccctacataaaattccaaaaaactagctgggtatggtggtgtgcgcctgtagtcccagctactcaggaggctgtgggaggactgcctgagcccaggaggttgaggctgcagtgtgctattattgtgccactgtactccagcctaggtgacagaatgagaccctgtctcaaaaaaattaaaaaataaaaaataagttatacttcaataaagttgaaaaatattagtgggacgcagatgagaagtgtctattcaagtctattcaatatttactatttatttatttatttttttttttgagacagggtcttgctctatcccctaggctggggtgcagtggttcaatctcagctcactgcaacctctgcctcctggcctcaagagatcctcccacctcagcctcccgagtagctgggactacaggcgcacaccactacacctggctaatttttgtattttttgtagagataaggtttctccatgttgtccaggctggtctcaaactcctggactcaagcaatccacctgccttagcctcccaaagtgttgggattacaggcgggagccaccacgcccagcctctattcagtatttatgaatcaaacacgagtatctccctcttcagcctcaaagtaattcacatgtctcatattaatattaatattttctgtactcttttatttatttatttatttatttattttttgagatggagtctcgctctatcacccaggctggagtgcagtggcatgatctcggctcactgcagcctctgcctcccaggttcaaacaattctcatgcttcagcctccgagtagctggaactacaggcggctgccaccacgtctggctttttttttgtatttttagtacagtgcagtggtgtaatccctcctacctcaccctcccaagtagccgggaccacaggcatgcaccgccatggctggctaactcttttatttttagtagagacgggggttcaccatgttgcccaggctggtctcaaactcctgacttcaagtgatctgcccccctcagcctcccaaagtgctggaattacaggcgtgagccactgcacctggcctgttttttgtactcttaaatgcagcagtgaaataacagagaaggaaaagggacagaaactgacatttttgagagctttactttctgtaggcgctatcagaggggtcatgtggatggtgtggtggagaatgtgagatttgtatctgtgacaatgagagcctggaggtcccaggggttcctgcttggaactttcccatgtgttatcatttaaccctcaacaccctgggaagtagatttttttttttttttttttgagatggaatctcactctgtcacccagggtggagtgcagtggtgccatcttggctcactgcaacctctgcctcccgggttcaagtgattctcctgcctcagcctctcaaatagctgggattacaggcatgcaccaccacacctggctaatttttgtatttttagtagagatggggttttgctatgttggccaggctggtctcgaactcctgacctcaagtgatctgcccaccttggcctaccaaagtgctgggattacaggcatgagccactgcgccctgctagaaatggatttttattgcactcgtgtttacagttgagcaaagaggctcggatttgttaaattacttccttgtcacatagccagtaagtggtggaaccaggacttgaacctgaaggtgtctctagagtccataatcatttgactacaaaactggacactggaatcttgtattcataatccttgggtcctggccaccaaagcctgtttcctgtgctttacagtgatcagggtccccaggagagccctcgaattctgtgcaacgccaacctacatgagtaagacatggagaagccagtccattgtttagtactagagttgctcaggctctgttaactgacctttctttctgttctctttctttccttatttgtttttatttagttgtgttcaacacaaatcaattccataccatgaagttactatgaatcagagcataaatacacaaacacaacgtgcaatgagaaacagatgcaggacacccagatatgaagcggaagggagggctcattcacacccacagtgcctggagatccgctgggtctgcttgttctcatgttggcttctagggatggcagagctggctttggttagtgagacccactgtggccatttggataccggaaatctctgcatgcatgtgtactcatgtgaaccaaaggcttcatggagtgtcaatttctttttctttcttttttttttttttttgacggagtcttgctctgttgcccaggctggagtgcagtggcacgatctgggctcactgcaagctccacctcccggttcatgttattctcctgcctcagcctcccgagtagctgggactacaggcgcctgccaccacgcccggctaattttttgtatttttagtagagatggggtttcactgtgttagccaggatggtctcgatctcctgacctcgtgatccgcccgcctcggcctcccaaagtgcttggattacaggcgtgagccactgtgcccagtcgggagtgtctgtttctaagaaggtttctctggactggggccattgtgaaagattaactttacagaattgagcctactttaggctcaagactaaccctctacagtaaccctcaggttctaaccattgagggacagggccttactctgttgcccaggctgaagtgcaatggtgtgatcatggctcactgactgtagcctcgaactcctgggcttaagggatcctcctgcctaagcttcttgagtagcagggactacaggcgcataccaccatgtgcggctaatttttacatttttttgtggagatagggcctcactatgttgcccaggatggtcttgaactcctgggctcaagcaattctcctgcctcagcctccccaaactctgggattacaggtgtgagccactgcgcccagcttcctctgaaatattgactgctactgacagatctggagaatactgacatcattctggtggctgaagtcttgtggcttggattcacatcatagctcaataaaatctgtttgagagcctgggtatccacaagctaaagtccagtctatcctcaactcaccaggtgcacaggctgacaacagttttattggtcaggactctttttcattcataaggagactttattgatgcatggaactggcatgttcagagggaacctgctctagatggggctcgctcctgtccccaggcctccatccctctctccttctctctcccttctggagggctttatctggcagtgccaggctggataatgtctagcctggacaataagacatcgtccagggagcacaatgtcaaccacaggtccagggtgcacactctcatcccacaatgcccggaggaagaggaggagtcctttccagaagcttacagatgatactttttttttttttttttttggacacagagtctcactctattgcccaggctggagcacagtggcgtgatctcaaatcactgcaacctctgcctcccgggttcaagcaattctcctgcctcagcctcctgagtagctgggattacaggcatgtgccaccacacctggctaatttttgtattttcagtagagatggggtttcaccatgttggccagtctggtctcgaactcccgacctcaagtgatctgcccgcctcggccccccaaagagctgggattacaggcatgaaccaccgcgcctggccaagacttttccttatgagcccaagcagcatcttcttggacatccttagctctgatttggccccacgaatagcactgagccaaatgcctcgggaggtaaccctgttgtgtccagtcagagcctgccgtgctggggccaggcctaccgaacctcatggttgagaatgatagagaatgaatctctctgaggacaaccagggcactgttggcagaagacagggccaaccctggagggccaccagcgtatttcctccagagctgcatcctccttaccttgaactgaccggcttacccccgaagtgtgtcaagtctggacactgctcaggccttagattgtgaaactccctgccgcacttgccactgctgatccttcttgaaattctctactttaatggttcttgaccctgtctgtcttctgactacgttaatgtggagaattttgcacttatcgatagccagggggttcagatatgctgggtatgagactggggtaggggtcaggtgtctgtttgcttacagagagtcctgggtgaccttgatgcaagtagctccaactaggaaccactaggcttctgtggcatcaccctctcctggtccactgtgcaggtatttactgagtatgtgagggacactcaggcaggtgctaagcatcagagatgaacaaaacaaggtcattgtgtgtccggagttggttccttccggtgggtttgtggtctccctgacttcaagaatgaagctgcggaccttcgcggcgagtgttacagctcctaaaggtggtgtgtccggagtttcttccttccagtgggttcgtggtcttgctgacttcaagaatgaagccatggacctcggcggtgagtgttacagctctcaaaggtgacaggggcccaaagagtgagcagcagcaagatttattgtgaagagcaaaagaacaaagcttccacagcatggaaggggacccgagtgggttgctgctgctggtggggggtggccagcttttattcctttatttgtccctgcccacatcctgctgattggtccattttacagaatgctgattggtccattttacaaacctctagctagccactgagcgctgattggtgcgttttacaatcctagctacagagtgctgattagggcattttacaatcctcttgtaagacagaaaagttctccaagtccccactcgacccaggaagtccagctggcttcacctctcaattgttcttacaaagcttttttttttttttttttttttttttttttgagacagggtcttgctctctatcacccaggcttgagtgcagctgtgcagtcatagctcactgcagcctccaattgctgggctcaagcgatcctcctgcctgacccttcagagtaactgggactacaggtgctataggcgcatgccaccatggctggttaatttttattttttaattttttgtagagatagggtcttgctatgttgcccaggctggtcttgaactcctgggctctagcgatcgtcctgccttagcctcccaaactgctgaaattgtaggtgttagccaccacgcctggcccatatgaagcttatatcacagtgggggatgttgagagagacaactaaatgagtacatgtccgaaggggttcagatagtgctgtgaactatcaggatgaagctgataggaggaatgaagaaagtcaatcaggatgaagtgatgggggaatggagagctgtcttagataggatgctcagcactggctgccctggccagcgcagtggctcatacctgcaatcccagcactttgggagtcagaggcgggaggatcacttgagcccaggagttcaagaccagcctgggcaacatggtgagacccccatctctactaaaaatacaaaaaaagaaaaaatagtggggcatagtggtgtggcttgtagtcccagctacttgggaggctgaggtgggaagatcatttgagcctgggaggcaaaggatgcagtgagccaagaatgcaccactgcaccccagcctgagtgacatagcaagactgtatccaaaaaatataggccaggtgcagtggctcacgcctgtaatctcagcactttgggaggccgaggcatgtggatcacaaggtcaggagattgagaccatcctggctaacatggtgaaaccctatctctactaaaaataaaaaaaaataaaaaataaaaaaaagtgggcgtggtggcgggcgcctgtagtcccagctactcgggaggctgagacaggagaatggcgtggagacaggaggcagagcttgcagtgagctgaggttgcgccactgcactccagcctgggcgacagagcaagactccgtctcaaaaaaaaaaataaaataaactggctgtcttgggaggtgatgaactccaggaggagcagacctaaaacaggagtgtgcttggtgcaccccaataaagaaggagattgtatgtctgacgtgaagaaggaagggcaaggggcgaggaggccgatgacaagataaagggggcatggccagatcccactgagtgcttcaggatgcagcaaggagaccagattcattctcagtgcaaggggcggcctcgtgttctcctcacatccctgtccatctctgttttttgccagctgctgtttctccacctgctcctaagtgctgctgttctcccagctcctctcattctacctgcaggaatcttggttactttcacgtggtaaccgagaccccctgctcctcggctatggactcaggtatcaaacactggcaggaccctctgtctgtatatcctgtgggttcctcaaaacttgcgcaaagccacctagcatcatctgtcaatctcctccactccctgtgtctccagctcagctaccaacatgacccactacccaggcatctaatctagaaacccaagtgtcactatgacttcccccactcctcaccaactactgccaatgcattaccaattctttttaaaaattttttcttcttattatttttttaggcagggtctcgctctataacccaggctggagtgcagtggtgcaatcatggcttactgcagcctcgacctcctggattaaagtgattctcccacctcagcctctcgagtagctggtgcagtccatcacgtctggctgatttttaaaaaaattttttatagagaaggggtctctttatgttgcccaggttggttttgaactcctgggcttaaaagatcctcctgccttgaactcccaaaaatgctgggattacaaacatgagccactacatccaaccactaactctttttaacctctgaaacatttctcagatctctttttttttttttttttttttttgagacagagtcttgctctgtcacccacactggagcgcactggcatgatcttctgcctccctggctcaagtgattctcctgcctcagcctgccgagtaagtgggatcacaggcatgagccaccatgcccggctaattttctgtatttttagtagagacagggtttcaccatgttggccaggctggtctcgaactcctgacctcaggtgatccacctgcctcggcctcccaaagtgctgggattacaggtgtgagtcactgcacctggcctcagatctctcttctcctcactgtccttccttctaggattctgaactgatgaccacagctcttccctagggagctgcagcaacccctaatcagagcccctgccctcaaatacaggcctcccctcctcccctcatcctgctcttcctgactttggcagacagcaaagcctggataacaaagggtggactcagggtagaagcagagaggagactcggcctaacacacacaggctttctgcatccaaggccactatctgggctttgagaaaagtctgtgacgtgtagatgtctctcccagccccgcaggcactggcatgggaccctctcacaagggacccaggaagaaactaagaagagtcggcttgtggggaaggaatgcggaaggactaaagggattgaggaaggcctgttgcaggagagaaagaagaggtgatcaagaccagaggctttgtttctgagggaccgtgggaggatggtacggtgcttcaagcactggagtcagagaacacattcctgttaaggagctggggaaaggaattcacacgaggagaactgctgccgagcactctgaacattctgtgtattgtcgggcggggatgtccagcttgaacctaaaaagaagggcatttcacgtgcccttggtcatgacccacatgcaccggatggccagcactaaggctgcctggcaatgtatccctccctccaagctcacagtgccacaaaggccctatcaggctctgctctcctcccacacacctctccagcctcaccctctcaccacttccagaaccggctcttacactccttagggtccacacatgccatgctgttctcactgtctgcaataatttcaccccatgaagcacttcctccctgagctttctcctgcctgctgtctgttcgtcccctgactgatgttagcatggacgagtattatataatggggggcaaaacatgtttggacatcacacagtcttggattagaattccagctttcctctacactccctggattagaattccagctttcctctgcactccctttaagaccttagcaatcactgtgtccatcttaccatgagtgaaatggagtttattccaggactatttgcggctcaaatgacttttataaagtgctctgcacatagtaggtgctcaataaatgttagcgccccttctctgcccttgaggcactcgattaatgcttttcaattctagagtcactgaacagctaccatttgttggaagctaccaagtgtctggtggcactgtcttttctccttttccatgaccactcttacttatcctgagtgtgattctcttttctcatgcattggaactgatgtgctggccatgcagaggaataggcaggacctgtcatttactgagggtccactctgtgcctgaccttcacgagctgttttccagacagtctctcagttaatattcacaatgactctttgaggtttgttgtattaatcactatcttatatatgagcaaattgagactctgggaagttaaataaccttgctgagattaaacagccaggactgatagagccaagacagaaatccggtcttctggggccaggtgtggtggctcatgcctgtaatctcagcactttgggaggccgaggcgggcagatcacatgaggtagggagttcgagaccagcctgaccaacatggagaaaccccgtctctactaaacatacaaaattagctgggcgtggtggcacatgcctgtaatcccagttacttgggaggctgaggcaggggaattgcttgaacctgggaggcagaggttgcggtgagctgagattgcgccactgcactccagcctgggcaacaagagcgaaattccgtctcaaaaaaaaaaaaaagaaaaaagaaatccagtcttccagattccaaagcccatgatctttcaaatggactccatttcctgtcagaaaggatactatatactagtaacagtaataaaaatagttaacacttagtgattacatatggactgggaactattctagctgagtacttgtgttaatttaattaacctttgcaaacatcccatgccatcgttcctattattatcccattgtacagataactgaggcacagaggggttaaacaacctgcccaggtcactgagctgaatctgtgtgcatagaaattacagtcttcattctattttcttctttcaaggagcacggtaagatccatgttcacatgagagagaataagtggaaacattttacacactgtaaatgcttgagagatgttcgctgttatgttgaaagttgagtgaggggaaattctgagtggactcagagtttgaaaaccagggaacaagagcactgttctgctggaactctcttgagagtccaggggcggccgtctccccaggaaagcagggtagcgtccaagaatcatgcagcggtcagaggaactcagagactgacatttgtcacctgtccctggagagctgcagaaccataagccttacaaagatgattagcagcccacgagaccacagacagctcttccaaccagcaaacagagttggcactcttgcacaatcccctgggagtgcgtcaccatgatgtcaccttgtttattcctcgcgtggatatcaggccccaatgggcctgatgaactgccggccacagacagcaaaatgacaacgctttgtaacttatcctggtgctttaatctttgctctgattctgcgatttagaagcaattctgtgtcacttcccctcaatcactggccatgtcaccataccagtgcagggtgacaatcattcatacagaaaacatgtaggcgctgagagcctctttctaatcctgctccctgagcagctgctcaggaggcgttggtgaatgagaatagcagggtcctcgttgtttaggaactgagtccagcagggtagggggacactgaagaaaccaagttgtactgggagtttttataaaggagagttacagagagccatggaagtgtaagtctggggcccccattcagtcttgggagggcagaggatgcctcccagaggaactgatgtctaagctgagccagcaggttaagtaggagtcagtcgggtgaaagaaggaaagaacagcacaagtggtggcagcagacagcaaagccccaggaatggagacgatcccagttgtctggaggttagagagcccgcatctcaaggtaagcgggagctgctaggacacaatgctggaggccgaagtgagctgttaagagttctgggacattttgtttttgaagggcaatggagacattccaggattttaagttgggagcaacatgatccgatctgtggggtttttgttttgtattgttttgttttgtttttttgagacggagtctcgctctgttgcccaggttggagtgcagtggcatgatcttggctcactgcaatttccacctcccaggttcaagcgattctcctgcctcagcctcctgagtagctgggattacatgcacgtgccaccatgcccagctaatttttgtatttttagtagagacagggtttcaccatgttggtcaggctgtctcaaattcctgacctcaggtgatccacccaccttggcctcccaaagtgctgggattaccggcgtgagccactgcacccggccagatctgtgtatttttagtttttaattctgtttttgtttttgagatggaatcttgctgtgttgcccaggctagagtgcagtggtactatctcagctcactgcaacccccgcctcccaggttcaagtgattctcccgcctcagcctcctgagtaactgggattacagccatgcaccaccacgcccggctaatttttgtatttttagtagagatggagtttcgccatgctggccaggctggtcttgaactcctgacctcgtgatccacctgccttggcctcccaaagtgctgggattataggcgtgagccaccttgcccagcctgagaaatataatttaccctcatattctttaatctcccccaaatcccattaattattgctcttaaataaagagcattatatgctttaatctccccaaatcccattaattatttaagagcaataatttttaagagcaattattaatgggatttggggagattaaagaatataatggtaaaaaatcaattatttttcatctttgtcattaaaaaaaaatttgtcagagacccacctgcatttgctcggcactactcagccccactccgtactgctcacgtggagggagtgatcgccatctaagagcttagcgggtgatcaacggcacatccattctttcaggaaacacctagatgcttaatagcaagcatctctcatgtgccaggcactgcacgaggccctgtaaacgagatgccaactctgcttggaagtggtacggtggaaggggcattgggccaggcagacatgggctcaagctcctaccccagcacctcctgagggaactccttcaaccttttaggaccctgatgtcctcacgtgtaacactggaataaagacacctggcttccacagcccatgtatggatgaatgggaatgcatacggaaagcaattgctcaaatacataccaattcctcccaccctaccccagttcctccaccttccaggttttagcgtctagatgaaaaccaaattctataaatcaggtttaagaaaacattcctggctgggcatggtggctcacgcctgtaattctagcactttgggaggctgaggtgggcaaatcacttgacgtcaggagtccgagactagcctggccaacatggtgaaactccatctctactaaaaatatgaaaattagctgggcgtggtggcacgcgcctgtaatcccagctatttgggaggctgaggcaggagaatcgcttgaacccaggaggcagaggttgcagtgagccgagatcgcgccattgcactccagcctgggggacaagaatgaaactccatctcaaaaaaaaagaaaaaagaagaagaagaagaagaaaacgttcctgagtagaaaacccacacaaagtggacagacctaataataatatttccaaaacacatctattgtcatcattctggatgggcaagtagctgccctctcagtaagctttttttcattaaggaaatatattagcttacctgtcaaacttgttttcttccctgtaatgcaagcaattgcctatgcttcccaaagcctggaggccaatctactgccactgctgacattgacccagtggccagttagactaatattcaggacttgccaaggtgctctctccctggaggcctcctaaaatccttaaagcactaactcaacatttcctcttgagctctcttcaagccgaatcagttgcttcattttcacttcttcataaacttagttgttaataattttatttttcatttttagcatttgcttgtttttctaatttcttccaattttaattttctaatgtcttgaccttttataaaagaaatggatgatgatgctattccttcttctattccttagaggactgtaagtacaattttttgttttgttttgttttgttttgttttgttttttgagatagggtcttgctctgttgcccaggctggagtgcagtggtgcaatcttggctcactgcaacctccacctcccgggcttaagcgagtctcatgcctcagcctcctgagaagctgggactataggggcccgccaccatgcctggctagtttttgtatttttagtagggatggggtttcaccatgttggccaggctggtctcaaactcctggcctcaagtgatccacccgctttggcctcccaaagtgctgggattacaggtgtgaaccaccacgctcgaccaagtcatcttaaaatcattttcaggcccaggcgtggtggctcacatctgtaatcccagcactttgggaggccgaggtgggcagatcatgaggtcaggagatcgagaccatcctggctaacacggtgaaaccccgtctctactaaaaagatacaaaaaattagccaggcatggtggcaggcacctgtagtcccagctactcaggaggctgaggcaggagaatggcgtgaacctgggaggcagagcttgcagtgagccgagatcgggccactgcactccagcttgggtgacagcaagactctgtctcaaaaaaaaaaaaaaaatcatcttcaggttgttgttttattttcattttatctggaatgaattcatctcttcttgattgctgattttgtttggttctgtatcttattatcattgattttcctaatagactttgggatcttggtttgctcagtcttcttgagggcacttttcccctcttgatcaccccagtttctctgctgcgctccatctttcctgtctagcagtttctagttgcctctatccagcccctgtggctcctagtccagaattgagtctctgttggtgcctgggctctccactcatagaggagaaatgcagttccaggccccaggtcactgcaaagactggcccaagtcttggtttctctgtctcctgagaaacataagtttataagccatagttccaaatagctgccgactgcagatttcttagcttcctttcacagatgcaaggtatctgtgcacgtgcatgtgcgtatttgaataaagagatccttccccttccgggcgcggtggctcacacctgtaatcccagcactttgggaggccgaggcgggtggatcacccgaggtcaggagttcaagaccagcctgaccaacgtggtgaaatcctgtctctactaaaaatacaaaaattagccgtgcgtggtggcgagcacctgtaatcccagctgcttgggaggctgaggcaggggaatcacttgaacccagaaggtggaggttgcagtgagccaagatcacgccatcgcactccagcctgggcaacagagcaagactctgtctcaaaaaaaaaaaaaaaaaaaagaaagaaagaaaagaaaaaaagaaaaaagagacccttccccaggccccaatttgaagcaggaggtctgagttgttcttgcactttgcttggtgcccttgccatgcctgtcactgagtaaaaacccaattcctgcttctccacccagagccctgcaggcccattcgtcactcatgtatctttgttactactccgcagaaatatgtattacatgtttcagtatagtgggtttttttctgtctctttttatcatttatctgtcatttcatatatttggaaaagggaaaccctcaaagcacaatcttaagaaattatcttgacctgagctcccacactgcctgcacagacctttgctagtgcacttattacatggaattataactgtctacgttgctgacaccaccagttccccaaagccatgggtcaagtggcagagccaggatttgaacctcagtctactgacaccaagtcctcttacctagtatgccgatggatgaatacaaccatttacatcttcccatcctgagtgccttgcacaagctctggcataaaatatgtgctccgttattatttgttgagtaacttaaacttagactcccactactgtcttctagatttatcataattctcttgtccttttattccccctaaatctagcacagtatccctctatttagacatgcaaggtaagtgaactcctgactctctccctatcctggccttcctgtgcccataacaaacatcatggccaaagaactctctctctcatgggtctgaccctttctgtacaaccttttaagaaattgattgtgaggctgggtacgttggctcactcctgtaatcccagcactttgggaggccaaggcaggtggatcacctgaggtcaggagtttgagaccagcctggccaacatggtgaaaacccgtctcttctaaaaatacaaaaaattatctgggcagtggcggatgcctggggatgcaggggaatcacttgaacccagaaggcggaggttgcagtaagccaagatggcaccactgcactctagccggggcaacaagagtgaaactctgtctcaaaaaaaataaataaataaaagaaattgattttgataatcatttgccctcccagtgtagacacagatttctcttttgccaattggaaatcctaaagccatcctccacctttttgttttttgagacagggtctacctgtcacccatgctgcagtgcagtggcctgatcatggctcactgcagccttgaccccttgggctcaagtgatcctcttgcctcagcctactgtgtggctggtactacaggcatgtgccaccatgcccagttgatttttaaaaatttatttgtagagatgaggtcttactattttgcccaggctggtcttgaacttgtgggctcaagtgatcctcccaccttggcctcccaaagtgctgggattacaggtgtgagccaccacacccagtcccttaaagcttttgaaagaaaaaagatgggaaaattgataaattaagctcatgcagtggtctgaaggagtgatctggaattttacttctctctttaattttggcctaaaatgtgaaaaacaaacacatctcgacatgatgcaattctgtgatcctgggttatctataagcagcctccaactaagaaaatcacagtaatttcccataatattactttatatttcaataacactcatctcaatttcataccaaaccaattacgtgggtgttatcgttcatgttttaacacatgatgaaactgaagcagagaggttaagtgtcctggcgaaagtcacacaatggataaagggcggagcctgtacccaaacccagatctttctttccatttctaagccttctgttgcctaatacatcactgctatacactaattttcaagtgccagaaacatgaaggtgaccttcagagtcatttttgtttcaatattatctttgaataatatataaagcattcgcaggtcactgacttttatttattacgtgtctctctgtctttttgttttgttacttttttggttgttgttgagacagtgtctaactctgtcgcccaggttggggtgaagtggcgtgatctcagctcactgaaggctctacctcccaggctcaagcgatcctcccacctcagcctcccgagtagcttggactacaggtgcacgccaccatgcccggctaattttttgtagagacagggtctcactatgttgcctaggctggttttgaagtcctgggctcaagtgatcctcctgcttcagcctcccaaagtgctgggattacaggtgtgagccatggcgcccagacctgttctattcaattttataggtgcaatgctgtgtgtgcctggggtcagggactgctttgcgttcccagtggcttgtgaagtgccagaccctgacacatgtttgcagagctcccagacctttatcccgaaggccacacaacctgaaggcccagggtaaccagcaaggtcccaatgtcccataatcttattcttttttttttttttttttttttttgagacagagtcttgctctgtctcccaggctggagttcagtggcgcgatctcggctcactgcaagctccgcctcccacgttcacgccattctcctgcctcagcctcctgagcagctgggactacaggtgcccgccaccacgcctggctaattttttgtatttttagtagagacggggtttcaccgtgttagccaggatggtctcgatctcctgaccttgtgatccgcctgcctcggtctcccaaagtgctgggatcacaggcttgagccactgcacccggcccatcttactctttttcaataaagacagctaggtaaatgtataaccaaatttgatgtaagttatatacaaaccttttcatatataaaataccacaagtcacacatatttttacaattgtttttgaaactcagttttcctgctttagccagaaaaatagtcattgtcagatcatgatttgtataaaatgctttgtgactcagtcaaccaccagctgacctcacgatacaaaccttagttggcctcacctttcctgtggttttcccacactgtttttatagctttcatttaaaataacattcagttgagcctccaatgaaaccaagcctttgttctcttcctcctgtttttcctccaaaagaactgacaatataagccttttctctggctctggttaagtacaaacccatgatcaagtggacccagggacttgctgggttccaggctcttactaccaccaccctgacagtcaaccacaaatacccgtcaccgccatcctcggtatttcatcatcacaatcgccaccactagctgagctcttactatgaggcaggtacttactaagctttcacatgaatcaggaattcatgtaattttaattgccacaacaacactatggagtaaatactacgatgttcttttaatatataatgaaattgagactcaaataagttaagaaaacttctccaaagccacagagctacaagcgtaaagacaggattcaacaccaggtcatttccagtttcaaatcctcaggataccccatattaaatatgcagtctgtacatataacacacacatacagacatatgagaattgagttgcagctatttgatataagaccatattttagagacatttaaacatttgttaatgatgttattatgattatcttttcaccttctggagtcaaaattttttttttttttttgagatggagtctcattctgtcgcccaggctggagtgcagtggtgtgatctcagctcactgcaagctctgcctcccaggttcaagtgagtctcctgcttcagtctcccgagtagctgggattacagatgtgtaccaccacacccggctaatttttctatttttagtagagactgggtttcgccatgttagccaggctggtctcgaacccctggcctcatgtgatccacccacctcagcctttaaagtgctgggattacaggcgtgagcaaccacacccagcctggagtcaataaagatttttgctccatccaaaactttggtcagctcttgagagactcatagagtccacagggtaggcctaggattcctgacaaataaaacaatgccatcaaatagcaacatcatttaaagaatacagacatgctactgctgggaaattctttttttgttgttggttttttttgagacagggtctaactatgttacacaggctggagtgcggagtgaggaccacggctcactacagcctcaacctcccaggctcaggtgatcctcccacctcagactcccaggtagctggggctacaggcatgcaccaccatgctcggtgaattttctgtatttttttgtagagacgggggtcttgctatgttgcccaggctggtcttgaacttctggactcaatcaatcagcccatcttggcctcccaaagtgctgggaatacaggtgtgagccaccgtgcctagctgggaaattcttattttggaaggagaagtacagaaaagaggtagagtatgtttttatttttatttatttattttattttattattttcttcaggccagatgtttttatttttattttttgagacagagtttcactctgtcactcaggctggagtgttgtgggtacaaatggctcactgcagccttgacttcctgggctcaagcaattctcctgcctcagcctcccttgtagctgggaccaggtgtgtgcactactacatctggcaaattttttttacttttttgtagagatgagggtctcactttgttgcccaggctggtctcaaactcctggcctgaggggacctttctgcctcgacctcctaaagtgtgggattacaggtgtgagccactgcatccgacctagagtatgtttttaaattaagttttttattttgagatcgctgtagattcacatgcagttgtaataaatgatagagagtgatcccatgtaacctttacccagttccccccactggtaacattttgcaatgctgtaatattaatacaatttcccaaccaggatattgatagattcactgattttagctcttatttgatgtagagtatctttttttctttgggacagagtctcactatgtcacccaggctggagtgcagtggcatgatctcagctcactgcaacctccgccctctgggttcaagcaattctcgtgcctcagcctcccgagtagctggcactacaggcgcgtgccaccatgcctggctaaattttgtgtttttagtagagacggggtttcaccatattggccaggctggtctcgaactcctgacttcaagtgatctgcccgcctcagcctcccaaagtgctgggattacaggcgtgagtcaccaggtccagccagggtacttatcttgtttctactatcttgctattatgaatgatgttgtgatgttgctatggatattgctgcatgagtttttgtgtggatgcatgttttcatttctcttggatatatacctagaggcagaattcttgggtcatatgatgactacacggaactatcaaactgttttctgtagtagctttactatgttacattcccaccagcaatgtacgagggttccacttactccccatccttgtcaacacgttgtgcatttttttttttttttttgagacagagtcttgctcttttgcccaggctggagtgcagtggtgcaatctaagctcactgcaacctccgcctcccgggttcaagcaattctcctgcctcagccacctcagtgcctgggattacaggcatgtgccaccacacctggctaatttttgaattttagtagagatggggtttcaccatgttgctcaggctggcctcgaactcctgacctcgtgatccgcccgcctcggcctcccaaagtgctgggattacagacgtgagccaccgcgcctggccatctgtccttttgattatagattttgattatagatcaaaatgggtgcaaatcaaagccacagtaagacaccacttcacacctgtgggggtgaataggtgtgaagtggcatcttactgtggcttttatttgcactgccctgatggctaatgatattgaacatctttttatgtgcttattggccatttgcatatcttctttggatgtaggtggaaaacttttttgttttttttttgagatggggtttcattctgtagcctggctggagtgtagtggcgtgacctcaggtcactgcaacctctgcctccagggctcaagcaatcctctcacctctgtctcctgagtagctgggactacatgcatgtgccagcatactaggctaattttaaaaattatttgtagagatggggtctccctatattgcccaggctggtctcaaactcctgggttcaagtaatcctcctgccttagcctcccaaagtgtttggattacaggcgtgagccactgcacccagccaaatcctttttaaagtcgtgaatgtacttgatgacaaagtgaatgtgacaaggtatttcccacaattttatgttagaatagaagaaaaacatatgttttatgcaattacatactcactcattcattttccaagtacctatgctattccagacaccaggaaatttagagaagaaggagaaaccagttagttgattatcagaaatggcatagacaagatgttatagtcctcctggcacttttgtaacagtctgcttctgacttatccaaatggttcagctccattcctggcagggcagaaaaggcaatgagacaaggttcctgatttccagtagctcactatctagtgggagagagaaacacataaatatgtcattgcggtcgcagatggttatctacccacagagcttaggagcacagtggagggagcaggtaattctgctaggcacctagaaggggtgcaggaggaggtgacatttgaatttggtcttaagagatattcagacatttgacagatggtgaaaggagaaggacattctagccatcaggcacggcctggtcaagggcatggctgaggatgtgagagccgagggtgagcagagacagagggtggaggggaggagtggaagggagtggaccacgtcatgaagagcctcactaaggagcatccatctacaaacagtctcactctgcgcccaggctggagtgctgtggtgtgatcttggctcactgcaacctctaacctgacgggttcaagcgattctcctgcgtcagcctcctgagtagctgggattacaggtgtgtgccaccacgcacagctaatttttgtatttttagtaaagatggggtttcaccatgttggccagacttgtcttgaactcctaacctcaaataatccatctgccttggcctcccaagagattttttttttttttttttttgtaagcagaagagtggtgtggttcgatctgaggtttaagagatcactcacaggcagccagttggatggattaaggggtcagcaggccaaagggtaaatatttgtggccttgtggaccacacagtctttgttacaacttctcaactctgctgctgtagtgtgaaagcagccataagacaatacatttaagtatttcatttaagaaagaacccggctgtgttctaatgcacatgtatttacaaagccaggaggtatggatctgtcctgaggaccatcatttaccaactcctatattagactaaggtgggaatgaaggcaaggagaccactgactatgtggaaattctctcatgaatggagaaaatcagaatggggtgagggaagtgcaaccaaggcagagggtatctttcagcctcaagaggagtcaggtcctctacctcggctgtgctggaaagtgtgactacacgcctcacggcccagctcgcatttcctacaaagcaggcagaacacctagttatgcaaagagcatcactcacagccactgcagccacctgggaggtgtggagcttctatctgtgacaagcctgccaaggaactcacaggcccaggcaaggagaagcctagaaaacaaggtagaaagtcttggaaaagcctcatttggtctgcgatgtaagaaaacttgattccagttaattgaggtaaagaagaattggttcaatctcatagaatccacaggggagatgtgtgattggtcccgcactctaagagctggagagcgagaagcaggtgcctcttctggcctctgtggggctgcacagactctgtctccgtctcttctgcaaaattggcatccatgtgtggactgctcatcagtcagtgtggggtggagacacagagaaagttcaggagtacataagtggccccataaaaacatgcaccctaccactaccctggagggcagctgaccgggggtgtctggtccagcctctctaacaactcctgcacctctctgtccaagccccttccccttgctgggcaaaataaagggggcagtttcgatcactggctctcaactgggatttctcccaaagtagtaatgaggtcgacttgcaagcatttttggctttcaaaaagccatttaaaatgctctgcttgctgatgaaagctgtggtttctttgctctcggctacgattctgtcaactcagggtagtaacactgctgagcgcgtgctgatctgaagctctgattggctgctggtgacataataggaaggtcaggaacgattggctggcagctgagaccggctgagccacataccaggaaggtgtgttgggcgtgaacagagcacgcttagagcaggaacagaagtacgagcgacagcctaccaacatccttcaagcatgggggcaggggaggcatgtgttaaataacagagtcttcaagatagtgaaaactatgcatcatttctagggtcctcttttgtgtagctcctgtctccccctagtcccaggtgtctctccccagagggctggagggccaggccaggctcgcagacaagtgggtacatgtacccccttcactcccagttccctcctctctgcccagacctgctctccgcagccctgaggcgggcagctggtccacccttctcccctgcagttctctctaggcttaggacccaggtccctccctgctctaggtggtctggatgtcagcatctcaagctgcggcctcaggcagcaacaggcacgccctttatgaattatctgagcagagcacagccacagtgggaggaataaaaataacaagaaacacaaaaggtgcctccttgaacaggaagagacactagggatgggggactggctcacctggtgagtcaccctgcgttccctcttcttggctggctatcaaaagagaagagaacacaggcaataacctgtggcctccagggacgggctgggcgttttagaaaggccctgggtttgcagaagagaacagcacgcatggtggggaggctgctggaggttgggattctacgtctggctcatggcaaacctgatggatgactttgggctcttttcagagtctctgttgcctcatttgtttgtttgtttttgagacggattatttatttatttgagtcggagttttgctttttgtcgcccaggctggagtacagtggccagatttgtttgtttgtttttgagatggattatttatttttgagacagagtttagctctttgttgcccaggctggagtgcagtggtgtgatctctgctcactgcaacctccgcctcccaggttcaagcgattctcctgtctcagcctcccaagtagctgggattacaggcgcccgccaccacgcccggctaatttttgtatttttagtagagatggggtttcaccatgtttgccaggctggtatcaaactcctgacctcaggtgatcgacccacctcggcctcccaaagtgttgggattacaggcgtgagccaccacgcccggcctgtttatttatttttaattttaaaaagtttatatatttaaggggtacaggttcatttttcttacatgtgtatattgtgtagtggtgtacccatcatcacccaaatagtgaacactttacccaacaggtgattttccaaccctcaccccctcccactttttatagtctccagtgtctgtttttctttttctttttttctttttttttgagacagaatcgctctctgttgcctaggctggagtgcagttgtgcaatctcagctcactgtaaactccacctcccaggttcatgccattctcctgcctcagcctccggactagctgggactacaggcgcctgccaccacagctggctaatttttttttttttttttgtagttttagtagagacgggctttcaccgtgttagccaggatggtcttcatctcctgacctcgtgatccgccctccttggcctcccaaagtgctgggatggcaggcgtgagccaccgtgcccagcccagtgtctgtttttctactctgtgtgttcatatgtacctattgtttagctgtcacaagtgacaacaagcggtatctagctgtttcggagttatttcacttaggataatggcctccagttccatgttgctgcaaaagacgtgatttcattcttttttttaatggctgagtatatccatggtgtgtgtatgtatcacattttctttatctgatccttggttgatggacagtatatctgtgcgattgtgaacagtgctgtcataaacacatgagtgcatgcatcttttccctttgggtagatacccagtaaagggattggagtctaatggtagttctatttttagttctttgagaaatccccataatgtttttcatagagttgtcctcctttattaagcctcctattcagggtgaggcactgtgccaggggctctacatacattgatgctaatcttgagaatcatcctgccaagtagggtctttatcgtctccatcttaaagaacaggaggcagttccgagagattaagtaacttgcctgctgtcacacggtatactcttgattcaaactcaggtctttctttctctctctttttttggaatggagtctagctctgttgcccaggttggagtgcagtggtgcgatcacagctcactgcaaccttcgcctcccgggttcaagcaattctcctgcctcatcctcccgagtagctgggattacaggcacacaccaccatgtccagctaatttttatatttttagtagagttggggtttcaccatatgggacaggctggtctcaaactcctaacctcaagtgattcacctgcctcagcttcccaaagtgctgggattacaggtgtgagccaccatccctggccaaacccaggtctttttgattccaaagcccccaagtattgcttattttatttttgatttgcttaaaaaaaaaaaagctagttaatgactagcactttgtgaactatttttctcccaacatttttaattttttataaaatttaaaaaatagaggtggggtctcgctattttggccaggttggtcttgaactcctggcctcaaacagtcctcttgccttggcttccaaaagtgctaggattacaggcgtgagccaccgtgcccagccccaccccgacattttcttttttgactaccatcaagtactagcagaacatccagacctgttggcaaacaagcagtaatggagacacttggaaacttgaccctgagtagctcaacagcttgttttctccatgagccagtaggcttctagctgtgatttcattaatttataacagtatgcacatttaattaagcagaatgtttcttgcccaacctagatgctaaatccatcaatgtgttatgagctaaattgtggttcatacaatgagaaatagaaaagtcagtgttgggggccgggtgcggtggctcagcctgtaatcccagcactttgggaagctgaggtgggtggatcacctgaggtcaggagttcaagaccagcctggccaacatggcgaaacctcgtctctactaaaaatacaaaaattagcagggcatggtggtgcatgcctgtaatcccagttacttgggaggctgaggcaggagaatcacttgaaccaggaaggagaggttgcagtgagccaagatcatgccactgtactccagcctgggagacagagcaagactccatctcaaaaaaaccaaaacaaaacaaacaaaaaagaaaagtcagtgtttcatcatcttatgcaaaggaagctataatttccaggtgttctgccacctacaacaggtttgagcactcttgttctccgactctatgaacgcacactttgtgcacaggaaaacttcctggataaaacagagccaggcagagctctctcaccactgtagaatgaaagttgctttctttgcttccttgggaatcagaaaggtgctctgcccctttctatgtgcacctggaaagttctccatcaaaccaagctgacagggaggctctccagcctgccaataagagcagtgactgagtgccagagggactgttacctagatggccaggctagcccaagatggacagaagagggagcactttccgtaaaacagccacatgtcacaggccccagctgccgcctgcaatcctctggctcccaagactgcccagggccctactgctctccctgggaggtttgtcttggtctatttgggttgctataacaaaatgccatagactgggtggcttataaacaacagaaatgtatttctcagtctgcaggctgggaagtctgagatcaaggcactggcagattcagtgtctagtgagggctttctggttcatagatggccacttctcattgcaacttcacatagaagaaggaagaaaggatctccctgggtcttgctgatagtgtcctaatctgccctcatgacctaataaattcccaaatcctcatctcctaataccatcacattgaaagcattttttttttttttttgagacggagtctcgctttgttacccaggctggagtgcagtggtgcgatctcggcttaccgcaatctccgccccccaggttcaagtgattctcctgccctcagcctcctgagtagctgggattacaggcggctgccaccgtgcccggctaatttttgtatttttagtagagatggcgtttcaccatcttggccaggctggtttgaactcctgacctcgtgatccaccccctcagcctcccaaagtgctgggattacaggcatgagccaccgcgcctggccttttttaatattaagatgcattatttttgtacaggcattttttttggttgggggacacacaaattcagaccatagcaaggttccagccataagccagaatactttccttataactatcactgaaggaccactggtcagcccccacgtttgccaggctttggggccctagtccccctcttcctgtcacattccccgccaccaccctggtgatttccgaaacccatgtgaacaacttacccctcgactgtctttcaggacagtgttacaatttcaccaaggtggccaggacctagccattctgcagtcacatctccaacacttgtgtgcaaatggttatagatttagagagatgtgtgtgctgagtttaaataaagtcacgccactgcactggtggaagtaacttaactcagattcagatacaatcattatttactgagctcctaatgtgagctgggtgtgaccatctctgtcgtcccatttgatcctaaagataaccgtttgcgcagcattattcacaatagccaagatatggaaacaacctaagcgtctgttgacagatgaacagatcaagaaaacgtggggtgtgtttatgtatatatacagccatgcactgcatgcctgccgatgtttcagtgatggaccacagacacaacagtggtcccataagattataataccgtattcttactgaactgtttcttttttaagagaagtgtgtgtgtgtgagatcagaatttcagtgtccccatgaactcagtacattctacacttgtcttccagctgtttgcaaatgtttttcttttggttggtaatttttttagaaatagatcttttattttttaattaattaatttttttttttttttgagatggagtctcgctctgttgcccaggctagagtgcagtggcctgatcttggctcactgcaagctccgcctcccaggttcatgccattctcctgcctcagcctcccgagtagctgggactacaggcgcccgccaccacgcccggctaattttttgtattttttttttagtagagatggggtttcaccgtgttagccaggatggtcttgatctcctgacctcatgatccgcccacctcggcctcccaaagtgttgggattataggtgtgagccaccgcgcccggccatttaaaattttttttttagagacagggtctcactatgttgctcaggctggctttgaattcatgaactgaagcaatccttctgcttcggcctccaaagtaggtgggactacagatgtggaccactgtgcctgacttactgtacctttgctatgtgtggacatgtctagacacacagtgctcaccactgtgttaacaactgcctcggtattcagcacagtaacctgctgtacaggtttgtggcctcggagcagtaggccatcccatgtagcctaggtgtgcagtggtaggttaagccatctaggtttctgtaagtgcactctatgacgctcacgagaagaaaattgcctgacaacgcatttctcagagggtatccctgtcattaagtgacacgtgactgcagagacagaccatccaggacttaacgctctttcgactttacgatgaattgatggggacgcagccccattgtaagtcaaggagcctgcaaacattatttcaccataaaagagaaagaaatcttgccatttgcgacaacatggatgaaacattggagacattatgcttagtaaaataaaccagatatggaaagacaaagactgtgtgatctcacttctgtgtggaatctgaaagcatcaaactcataaacacagtagaatcgtagttcctaggggtcaggtggaatgggaagattttggtgaaagggtacaaacattcagttctggggatctaatctacagcatggtgactacatttaaaaataatgtattgtctacttgaaatttgctaagagagtagctcctaagtgttctcaccacacagacaaaaatggtaactatgtgaggatatgggtatgctaattaacttgattgtggtgatcttttcacaatgtatacatacatcaaatcatgagattgtataccttaaatacatataattttttttgtcaactatacttcaataaagccggaagaggaaaaaaaggtaactatttgagcttttgcttcttcaattagagctaatccagctaaaaaatggtttgggcatttccaaaaaggagttgaggtactactaaatgacgtcaggattaatgttttaaccaaccaagaagcagcattgaaaaactttctaacagcttcgttgagatataatttacataccatagaattcagccatttaaagtgtacagttcagcaggccgggtgcggtggctcacgcctgtaatcccaacactttgggaggcctaggcaggtggatcatttgcgatccagagttcgagaccagcctggccaacatggtgaaactctgtctctactaaaaatacaaaaattagccgggtgtggcagtgtgcacctataatcccagctactcgggaggctgaggcaggagaatctcttgaacccgggaggcggaggctgaagtgagccaagatcctgccactgcactccagcctgggtgagggaacgagattccatctcaaaaaagaaaaaaagtgtaaattcagcgtttttatttatagagttgtaccgccatcatacagttttagaacattcccattaacctaaaaagaaaacttcccaattcttagcttcactcctaagcccccaagccccccattacccacttccggccctcagcagccacaaatctacatcgtgtctcggtacatctggctatcctggcatttcatgtaagtgacatcgtatagtatgtggtcttttgtgtgaggcttcttccatttggcatcatgttttcgaggctcatccgtgtcacagtctgcatcagtatttcactcttttttattgtcggttaacagtccactgtccagtttttgtgtggacatatattttcatttctcttgggtatatatacctgggagtagaatttctcggttatatgagaactctatgtttttttttcctttttagagacagggtctcgttctgtcacccaggctggagtgcagtggtgcgatcacagctcacagcaaacctccaactcctaggcttgtcaagtgatcctcctgcttcagcctctcaagtagctggggctacaggcacacataccaaacccagataatttttaaattttttgtagacacagggtcttgctatgttgcccagtctcaaactcctgggctcaagcaatggcccacctctgtgtcccaggaactctatatttaaccacttgaggaactgacagtttcctcagcaactgccccacttcacattcccattagcagcccatgagggctccactgtcttcatgtctctgtaaaataacacttgtttttttgtcctttttttttctcctttaatctcttttttggaaaaaacatcggaaaatgactatgtgtcttttttatttagccttcctagtgggtgtgaggtggtatctcattgtgatttgatttgcatttccctgatgatgagtgatgttgggcaccttctcgtgtttattggccattcgtgtatcttttttggagaagtgtgtgttcagatcctttgcctatttttaataaggttgtctttatatcctagttataagtgccttatcagatacatgatttacaaatatttttttcccattctttaggttagcctttcacttttttgagggcgtctgctatgctacggtttggatgtctgtcccctccaaagctaatattgaaatttgatgcccaacgttggaaatggggcctaataggaggtgtctgggtcatgggggcaggtccctaatgaatagattaatgccctccctcagtggtgagttctcactctgttagttcctgtgagagcaggttgttcaaaagagcctggcacccgccttttccagctctctctcgggccatgtgacctctacacactggttcccccttccccatctgccatgagtgggggcagcgtgaggccctcaccagatgcagatgcccaatcttgaactttccagccatcagaatcacgagccaaataaacctttactctttacaaattaaagggagagcaaagagaggaggaggaaggtgccaggctccttttaattgccaggtcgtgcaggaactatgagtgagaactcactcactccagtgagaatggtaaagcttttcatgagagagccagccccatgaccaacacacctcttaccaggccctacctccaacaccgaggatccaagttcaacatgagatttggaggggacaaatgtccgaactatacagtcaccatccatctcctgtgacttgacccctgctctccgtgttttcctctgattacctctcaggtttgtttgttctcttcatgctggtgtttgttgttggtgtgcccttgggtctcttctctgtgctccacagacttcctgagagatcctcattcactcccatggtgtctttagtcactatctattagctgccaattctcacatttccatttccagctccagacctggggagccaactgtttactcaacatcttccacagacattccaaacgcagcatgttcagacccgaattcatcaccatcctcctgctatccccaaatgtgcccctcctcctggatccccagctgaggaaacaggcataccattctcccatttgtgccagcgggagccttggcaagcccttctccatagtcagtcatcaagttgtactgagtccacttcctagacatcacttcaatctgtcccttttggtccattctcagtgatcctgccctggaccaccatcatctctcaactagatgactacagtcttcccctttctagtctattctccatagtgcagccacactgatgtttgtaaaatgcaaatccacttttgacactctctagctcaaaaatccctggctggctctccattgctctggggataacaatgaacagactaacaagaattttaagacctttcacgatctggcctcagtcatttctccagcctcactcctgcacagtatatgtctggcactttattcatcttgaactaactttagttccctcaacacactgtgttctcttcatttagggcttttgaatatccatagtcctatgtctggaatactcttccttctcctctggctaacccctacttgttcttaaagtaacaggctagacatcacttgctgcttccctccagattgggagaacaccaagtgactgaaagacagtttagtcaagaggttaagagggagggctttggaacctgatggcccggtttgggatccaggctgtcctgttagttttctgtgcctctgtttcctcatgcatgtaatagggaataataagagtccctgttacataaggctgtggtgagcattaaatgaataaatatatagaaagtgcttagaagagtgcctggcacactgtaatggctcaaccagtttcctgtcactttgaggtatctctatagttaccctatagttacccctgtaattaagtacttatcagagaaatctaattcacaatttactttacttttctgcattgtaagatccttagaattgggacaactctccagggctccagctcttggtatgcagagggcatttatgaaatttttgttaaatacttgactaaatcagtgaatgaatgaacttctgttcacagcattgatcgcttctcaccttgcattatgagagtggattttatcttctctatttgatttactgtaagcttactgaggcagcaccacagcaccgtcatcttggcatatcccatctcctccaaccaacactgtctgggaacattttattcctgtaattcaactaataccagttgaactaaagcctcctctctgggaataggctttagacttctcctgcttttcatctgccacgtcctgtcatcctcttctatgtaacccactgcaacctggaattttagggactttcttgtatctgtagctcagttgtcacagtaggacagttatacaaggagttggggacagtgaaattcaagttagttaggagctaaatttaggcagatgtcctgtagtgtttggaaagaatgatgggctcagacgttttgttcttcctgatctcagaaatgctactgaagctcttagccctgttataatttacccatatgtggggtgggtagaacagcatgctgaagcgaaaggggaattaagtaaaaagtaagagacccggtcaggtgcggtggctcacacctgtaatcccagcactttgggaggccaaggctggtggatcacctgaggtcaggagttcgagagcagcctggccaacatggcaaaaccccatctctactaaaaatacgaaaattagccaagcatggtggtgcacatctggaatcccagctactcaggaggctgaggcaggagaattgcttgaacctgggaggtggaggttgcagtgagccaagatcataccactacactccagcctgggtgaaaaagtgggactccatctcaaaataataataataataataataataataataataataataataatcatacaaataagagacccaggtttttgtcccagtcgtcaacaaattggtgtgaccttggaagtcacagcctgcctgggttgactcatcccaccggtaaggtgaaggagtttagatggttttaaagtttcctattaattctgacatatcatgcatgtatcatctcttctgatgtagctcattctaggaaggaattttctatggtcccacttcatctcagaaggaacagagaaaagaaagcaatgacaccaggtgtctttagctgcatggccagtgatggctgaaaataatcatgggtcagatcacctggatacacatggagagaacaacccacatcctgcaggcatggcccaaagatggggtgtgatactggaaagtgaatgcatttttgagtcatacagaactgaattcaaatcccactatggggctaaattaacctctgtaatcctgttttcttggttgtaaaatttttttttaaaagttgggctgggtgtggtggctcacacctgtagtcctagcactttaagaggccaaggtggatggatcacttgagcccagcagctcaagaccagcctaggcaacatggtgaaaccccatctctactaaaaacacaaaaaattagccaggggtggtggtgcgtgcccatagtctcagttacttgggaggctaaggtggtaggatggcctgagcccaggaagtcagggctgcagtaagctgagattgtgccactgcactccggcctgggtgacagaatgagaccctgtctcaaaaaaaaaaaaaaagaaaaaaaaagtgggatcgtatctacgttgtaggagtaggataaggattaagtgaggctgtttacatattacaccttctataaatcataggccttccataaaccttaggttttctccatttttatacagtccactagttcaaagtactttcacagataatggcctgtgcctgtgaaactttagtttactcctttattcctccccacacggttggagtttggggcatggacttttctgtgggttcaagctcagtgattttttggtgggacagagtgcctgagtcaatgagcatcttcccttagtttaatgcagcatctgatgagattcagtcctgtgtgtcctctagctcactgagggtgttttggagggacagggctcaggtaggactcggagcttgaagactcactgcaatggagagcctcaaaggagtaaggatccatgattcagctggagctgcagaccaggcctctggccatggagaccctcagcaaccccgagggtgctggacaagagcttctcctttctaaagtcctgcttatgtgccagagtataaaagaatctcactgagcacatggctattttgactctcatttagtggtcacttgggctctgatattattgcacttgtgggcagaggcagctcatcagtgctgggctttcttgcatttatggttttgccaaaccactttttctccagtctcccagggactgatgattttggagcacagtgaggaaactcaaccatcagctccaaacatcacctggctcaaccataaagcccaacatcacctggctaatctgtgacagagctgacctggggggtatgactagccacctttggtcaccaaatccaaagcttttcccaggatcacctggctaataaagggaaatgttaggattagaagccagggcaagcaacctggagacaagctctcttttaggaatcagacttttcatgagatagttgtaaattctgaaacaatgttttaaggaattctagccacaaatcaggacgatgtcatttgccaggcattgtttagtcaactggttatttttataagtgagtataagattcataactccaagagacagttatcaaatggcagtaatatcaacaataacagctaccatttactgggcacctattgtgtgcttagctgtggtatggtatagagaaacacctgcccatgatgactgagcagtggttaagagcactgagaccggattcagaccattcaaacatgggcttgaatcctggttctaccacttaactagctgtgtgactttaggcaaggtacttaacctctttgagcctgtttcctgatttgtaaagttagaataatagtatttgccttattgggttgtgtaaggatgaatgagttaatacaagaaacattgctccaaatagtaagcactatcaaattctcattactcaaaatgtaaaatgtggaaccatgttcaataaaagttaaagactacaacaacccgatacagacaggacccatagggacagctcttcagtagtggagatttgggccccaaccaggtaaggaactctgcccaaatgaagtacaggctgagggcaacaggaacacagaatgagtaaagggagaaagatgccgtatctactgtgatatcataacctttttaaaaaatgatgtggtggctcatgcctgtaattctggcactttgggaggccgaggagggcagatcacttgagttcaggagtttgagaccagctggtcaacatggtgaaaccctgtctctactaacaatacaaaaaattagccaggtgtggtggtgtgagcctgtaatcccagctactcaggaggctgaggtgggagaatcacttgaacctgggaggtggaggttgcagtgagccaagatcgtgccactgcactccagcctgggcaacagagcaagactctgtctcaaaaaacaaaagaaaccaaaaccaaaacaaaaaaggtaggcatatttccttccttgcgtggtaatgtgtatatacatactcacggacaggcacacgggtatttttaaccccttcccttcaactattttctatgaggagagtgggtggtggttaatgttataggctagtttctaaattatacaaaatccagttgggattctaattaaaagaggcattaacatcacccacagatgaatacagtaactgtagggactttgtttactctttcctgccagaaaagtgagaacacttcttttcttttctttttttttttttttttttttgaggaggaggagtctcgctctgtcccccagggtggagtgcagtggcgcaatcgtggctcactgcaacttccgcctcccgggttcaagtgattctccagcctcagcctcccaagtagttgggactacaggtgcccgccaccacccctggctaatttgagagcattttcttttgtacaaaggatagctgcatcacgttgggtggaaacaggaagctgctgctggtgtatggaaatttacatatgattgaagggtggatctggatgctcagtcaccacagggaggtgtttctctggtgagctcggccattcctctgtactccactctctactgctgggtaggagcctgcaaactatgttgcccaggtttctcaccagctggctttctattaggttttgctgattggagaccgtggtgtcagatcagaagataggaggaagagaagttcctgggtttgtctgcaactgcagcagcagttactggtggttgtcaagtggcatctggtttttgtttttgttttgttttgttttgagatggagtcttgctctgtcaccaggctggagtgcagtggcgcaatcttggctcactgcaacctccacctcctgggttcaagtgattctcctgcctcagcctcctgagtagatgggactacaggcaccccctaccatgcccagctaagttttgtatttttagtagagatggggtttcaccatgttggccaggatggtcttgatctcttgacctcgtcatccacctacctcggcctcccaaaatgctgggattacaggtgtgagccaccgtgcccagcctgtttttttcagtcagagtctcgctctctcacccaggctggcgtgcagtgccacgatctccgctcactgcagccttgacctcccggggttcaggtgattctgccatctctgcctcccaagtagctgggaccacgggtgcgcaccactgctcccagctaattttttgtttactttttgtagagatgaggtctcactatgttgtccaggcgggcctcaaactcctgagctcaagcaatccacccaccttggcctcccaaagtgctgggattacaggtgttagccaccgtgcctggcccaagtggcatctgggcagtggtggtgactctggcagctctagcagtggcaaaggcataagttttcagaggacttgtatacagtatctaatgctgtgtacaagtcttctgaactgtgtacaagtcttctgaaaacttaatgactttttaatctttttgagagacagagtctcgctctggtgcccaggctggtgtgggcttgtaggttccaatacagggctgttagcagcttcctgatgtgcagcttctctgcacgtaatccttccttctccagggtaccccttcttttttgtttgccagccctcccaacatctttgtaacaaaatccctacattaagttccatttatttatttatttatttatttaattttattattattattattattattattattattttttgagatggaatcttgctctgtcacttaggccggagtacagtggcacgatcttggctcatcgcaacctccacctcccaggttcaagcaattctcctgcctcagcctcctgagtagctgggattacaggcatgagccaccacacctggctaatttttgtatttttagtagagatggggtttcaccatgttggccaggctggtttcgaactcctgacctcgtgatccacccgcctcagcctcccaaagtgctgggattacaggcgtgagccactgcagccagccccttctatttattatacttagggttgttttcatttttcttgactagattgtgcagtggcacaatcacagctcactgcagcctcaaccttctaggctcaagcaatcctcccacctcaacctcctgagtagctggggctacaggtgtgtgctaccatattttaaagtttttgtagagatgcggaagtctcactatgttgcctgggctggtcttgaactcctgggctcaagcgattttcccacctcagcctcccaaagtgctgggattacacgtgtgagccaccacgcctggacaactcaatgactttaaatgacaatgatcattttcttattctccctcacacttccaaaagctgactgggcttggctaggcaggtcctgcttgggctctcttgttctgtcatagtcacagtggctggggctggagttaaaggcttgctcactcacttgtctggcaattgatgttggacatcagccagaacacctccatgtggcctctcccagtggcttgggcaccctcacaacatggcggctgggttgcaagccaagtgtcctgagagagagccggaaggaagctgtgtcaccttttaggacctagccttggaagtcatagagcatctcatctgttatattctacctgttagaagcaagtcactaaggcccaccgacattcaaggagggaaaatgaatgctactgctaggaggtgggccaaagaatttgtgaacatattttgaaaccgctacagggagcatctccagcaacacagcagcaggtgtgggcttgtaagttccagtccagggatgttagcagcgtcctgatgtgcagattctctccacgtcatcccttcttcctcctccaggataccccttcttttttgtttcccagcctcccaacatctttctaacaaattccctatattaaattccttctatttgatatacttagggttgtttccattttcttgactagactgactaatatatgagggactatcccatgccatctaaactcaccatctgaactggatagcagagatactatcatgatgtgccaagaaccacgttaggtaatttacgttatgtcatttaattctaacaccaaacctgacagatgggtataagaatacctacatcatagatatagaaactaaggttcagaagggttaagcaacttgaccaaggacacagctggaaagagttgagaaccaactccaggtgtgacaccaaagtacatttatttcttgagccttctggaatgagaagagctacttactcccgaagagttccacttccctcagagaaagtcttacctctcctccttatatggctttttgatgaatcaccttagattgaggaaaaggaagaatacatctggggcagtggaacacaaagacacaagtattcatcatttgtgaaaactgcaggctgtgtgagaaaaggcactacactggagtctggaagccagggttcaagccccagcaatgttactcacatatgttgggaccccaggcagtcacttcctctccagaggcctgattccatagctggagagtgaccctggtgttctgtgctccaatgagtatctagttggtaaagtatctactttgggaatataaaaagctctatcagatacagaggacagaagttaaagtaaaataaagccagattatagtgggtcttgaataggctgaggaaaaattcgtatcgtataagcagtggagaatccattttgtcgcccaggctggaatacagcggcacaatcacagatcactgcagccttgacctcctgggctcaagtggtcctccctcccaagtggctgggaccacaggcatgtgccaccacatctagctaatttgaaaaaaactttttgtagtgatgtgctctcgctatgttgcccaagctgctcttgaattcctgggctcaagcaactctccagcctcagccttccaaagtgctgggattccaagcatgagccaccatgcccagtctattttgggttctgaaggaaaaaacttacacaaataaacaaaaaggcttatagaagaaaataataggccaagcacagtggctcacgcctgtaatcccagcactttgggaggccgaggtgggtggatcacctgaggtcaggagttcaagaccagcctggccaacatgatgaaaccctgtttctactaaaaatagaaaaaattagctgggcgtggtggcagccacctgtaatcccagctactcgggacgctgaagcaggagaattgcttgaacccaggaggtggaggttgcagtgagccaagatcatgccactgcattccagcctgggcaacaagggcgaaattccatcttgaaaaaacaaaaaagaaaaaagaaaaaaaagaaagaaagaaaaagaaaaagaaaataataacaaaaccaataatacaaaggaaccacagcagcaacaaccatttgctcaatgctaggcacaaggtgctaccctaggtgttctacaggggtgagtgcacagaccagcacaactcgaagaggtctgtaatgttatttccatctcacagacagtgaaactattcagaggctcgataacttgcccaaaatcacatatctggtcagtagtggcgatgagatataactcagtttggctgaatctgaagtctgcactcttcactatgctatgggttagaatgagctgaactcaatagtaaacaaaaaataagtagacaaggaattattcaaatgtacaagagagcctacgggtctgcactagaatacttggcaatgcaaatacagagtgtgaggtgggacaaagacgatttgcaggaaaaaaagacaagctgaggttcaatcaaatagattcatatagcttgttaggtggatgaggtgggaggaggtggttgcttcccaacagctctttctcctcaattcccatttaagtgtctactccttctctgaagcctgtgagcctgaggggagggaagttacctcttgggctggggctggtggctcaggcctgagcctatcagcttagttccatcctttgtccatttactggctctgggatgggcatggcacccaatcagcatccgtgaaaccagacagaggcttgctaggggctgttgggaaggtttcttgcttttctaagaggccatctgaaaggagtcttctctgtggctcccagttgtgatttggaagcccacagcccttgaagctgctgccagcagtctcatgacagagcaaagccagcctcagcacgatgctaacactgcagagggcagagagatggagagaaactggggtacatgattctgtcctttgttgttcaaggcactctgcagtgggtttcctgttgcccaaacacgtcctaactgttacaataaggcaggctctgcaaggtgtctgttccaggctcctaacccaaaagtcactgccatacactttagtggagaacaaagaaacacacgaaaagcctagatccagggaaatgttgacgtgacacttgcgagcccctgctggaaaaaaaacaagtgaacaggatggagactagagacataacaagccaggcagagaaagtcaagcttccacaccctgtaagtttcctgggctacgtgttgacagcatacaagaaatttgtcatgtctgactctcacgtacctacagaatgcaggacaggcaaagctattctgcaggacccacatgactttgtacatggagagggttcttttcttctgatgctaagccctctaatatatttgggtcccaactggataaatgtctgatgcatacatttaaaaaaccaagtattatgcaaaccagggtatctttgaattcaagcaatgggtcaaagtaacaaacactgttctgtcaaaaaggatcaaacactttattcatctacacataacatatataaaagcaagcaaaatcaggatgttttcctcagccaccctttccacattttgtgcagttttagtgaactataaatcactgacttcttcaggcctaaaagagaaaagatgagaaagtaagaagatggaggcttgttgagtggatgctcagagtttcagtgacattctgagcagacttgtctttggaggagggcagtgaggggctgacccgtggctctaggagaccagggagctgaaggtgattaaaggtcactgtgatcaatgtagggggaaatgattctgatttcggcattttccgatttagggctatggatgccaacggttcctaagttattgggataagtgatccttttgagttatgaacatattggcagcctctgaatttagctctttcaaaaaggtaggacaaggataagactctgtatgccactgggtccccgttctctcaggcctaaattccaaccccacctcactgtctctatgtcactgtgaaaggcacctgtctgactatgacaaatgctgttcccatcactttctgcctcgttgacttggaatccctgtttggatttcttctctaggaagtgcttccctggacccacagggtggccccacagcatctgtgctcactcaacacactgtgcagtacgtgtgggccgattcacccacgcctctgcctggactgggagcttcctgaggacagggaccttgccctgttcacctaggtggccctgtcacctagtacaggacccagaacacagcaggtgctctgtgaaagcttttgaaatgacaagacaaatgtgcctcattcggagagctggccccctagcacccccatctacttagtcaggagtgtgtgatgaaactggagaaaggctctccgggggcttaggggaaagaagaaaaagggaataaaataaatgggtgttatttgtcagatctaagagtatcctatctgtggatgcgattatggactcaacttcctttgtgttgagggtgggatcattcagtttgtgtttcagggtgtggcccaaagatatgaacagtctttttcactgtgagacacaaactgtgatctgtgctatgagtgtaaagtgcacacccctggcagtgcactttggtgagcatgccgacaaggtaacaggtttcgctctggacatgcctagcactggggtttgagtgatggcttgaaaatatctggccctgttacctgtaaactgcttagtccacttagagccttggaaaagaccactgcagacagtggcaggggagcagtaaaatcattaatgaatacttccagacactctggcttcgtttgtctaccagctgactacttgcaaaccaacataacctagtcaacaaactcagagttcctttccctgcctccaccccttttaattttctccctggagcaaccactctggtaaaccccacccacttcagcattgagactagaagcttattatataaggtggtttttaaaattccagccagaaccaaccaaaagaccaagccgaatacaggtagttatacatggaaaggttcatatagcaaccccagggcactgagtcacagctagaggaggatgcatgggccatgataattcccagctcaacttcaaaaagcagttcctggatcttaaacatttaaggtaaatacataaagtagaagagtgtcaccatgtagccattttttttttttgttgctgctagtggacagaaatctcccttgactaaaacattctccctttcatggttctgccagtgagacattttcagaaagactgcagcagggaaatctgttagaaagagcactagaatcggagtcaagagacctggactctagttccaggtgggccacaaactaacagtggcctttccctgggcctcaatttccttatctgtaaaatgactgggttggaatagatgaggggttctctaacaaggggtccacagattaagtctgagtgtctgtgaactccctaacactgcaggaaaatctactgtgtgtgtgcgtaggtgcacttctgtgcagggcgtccagagttctagtcagattttcacagggatcctggacttgcaaaaggctaagaaccaacagatcagaatgaagagtcttttctgccttaatattataatttcaacagaggtggagaacttaaatttcatgattttggaataggcaaaaattttctaaacaggacacaaaaaactgctaaacatatagaaaacaaaatggataaactggactacatgaaattatgaacttcttttcaccaaaagacaccattaagagagtgaaatgacatggcttacagccataatcccaacacttagggaggccgaggcgggcagaccatgaggtcaggagatcaagaccaacctggccaacatggtgaaaccccgtctctactaaaaatacaaaaaattagccaggcgtggtggcatgtgcctgtagtcccagctacttaggaggctgggacaggggaatcgcttgagcccgggaagcggaggttgcaatgagccgagatcacgccactgcactccagcctggccacagagcaaggccccatctcaaaaaaaaaaaaaaaaaaaaaaaaagagagtgaaatgacaagccacggagtgggggattttgacatcacatgtatccaacaatggagttgtgccccgactacagagagaattcagtaagcaaaagagacaactcagtaggaaaatgagcagaagactagaatagacgcttcacaaaagagcatatccaaataaacaaatgaaaaatgctcaacttcctcagtcatgaggaaaatgtaaattaaaagatcaatatggtaccactagtcacccactagagtgcctaaaatgaaaaagacctaaacaggcattcagggaggtgctgcaacagaagctctgctagtgcaagtataaatgtggacgattgtttagcagtttctactaaagctgaacagtcacatgctttatcatccaggtattctacccctcagtacatacctgacaggaatgcatacacccacccaccaaaagacaggtacaaaaatattcacagcagcactacttctaatagtcccaagcgggaacaacccaagtatccatcaatagtagaatggatacattgcggtatattcacacagcagaatactgcactgggcagaaatgaaccactgctactcccaacacgatgaatctccctatgttataaatgaacagggaaaggcacaaaagaggacatgcttatacatggttaaaaaatgggtaaaacagaaccgtggcactgggagtcaggctggagcttactctcggagaagcaatgcctgtgacgggcatgaggggtactggggactggaatgactgtatttctttacctgggcactaggtctatgaggtgttccctttgtggaaattcatcagatttatgatttttgcacttttctatctatatggagatatttcctactaccagaaaatttagaatctttcatttatttggtcacacatagaacaaatatttattgagcacctgtataagcaagacactgaactagttgctagggatactggtacagataacagctatggtctctgccctcacagagtccacaatccatagacttctacttggtctacactaagcttactttcttcaatttttttttttttttttttactctgtcgcccaggttggagtgcagtggcataatcaaagctcactggagcctcgatcttctgggctcaagagatcctctctcctcatcttcctgagtagctggggctacaggtacatgccaccacgcccggctaattttattttatttttgtagagatggggtcttgctttgttgcccaggctggtcttgaacccttggcctcaagccatcctcccaccttagcctcccaaagtgctaggattacaggtgtgagcctctgtgcccagattacattaagcttactctttctacaggaaaggatgatgatttaggaattctgctcactccttccccagtggataaaaatgcaacatctctttagatgcattccctgtagagagatccttatttacctaaagctagtcattatgaattctggttagaatctaaagtcaggattttgttttagaagcatgcagaaagctatgtcactatatggctccttaggtttctcttctgatttccagcttgtttcacatgacctacagcgaagttaatacacacgtaagactatgaactccccgtgtgatcttaaaacagatgggctactgacagacaaactctccaggaaacaatgtgaggtagaaatatggctaggctgtgaaagatctctatctttccataatcttacgtttcagacctttgataaaattagtatccccaaaacatccttccagttcatttccaaccataagcagatatatcgacaaagaaaatctcttctgaggcaaaagtacaacttattttaagaactcacaggcttaagtgataagcaaatcagcaacagagcaccagtgttcttctaatttaaatatatagataccaacaaatggaagaaatgcttcagttttaagaaatcagaagcagaggataatgactaatccattctactgtgttcccggaaaaggctggtaaggatcaactgaggcatgccttttaggagcaagactgaacctgtcttgttaatttagtttagttgaatcttttgaagctagagaggtaaacaggtatttgtccccagagttaattctgattgaccacaaagtcaggtgggaaaaaataggatttaaaaattaaactcatcatcctcgcccaacctccccctctgctcagggaatgaatggctctactgcttcccaggccaaaaacctgggagttagttctgactcctccttcatgtcccatatccctttagtcaccaagacccagtcgttcccttctaaacacggcaaatctttcctgtctgaactgcaatgacctgagttcaggctgctgtaactcctcagctgactggctgtagccatatctatttggtctccctcgcaataggtttactgcccttccatttgatctctatgctctaactacggtagtctttcggcagtcctatggtgacttccctctgccctcaaaagaaaccctgaactccttaacatggcttttaaagtctttgtttggcccctgcttatctctccatctgatcactaaactcccccatttctcatctacctattcccacaccagagtactcagacagttccccttctctccactcgcgttagaaactttataaaaggctgctgctcgaatatgcagttgcttagctggtcttttgttgccagtttgagatgtgaggtcatctgctgctaccatgaaaggaagagcaggcaaattttaggaggctaaatagtcttttggtactcctaagccagctggcttcagttgctgatctgatgagaatgatgttattctactagcagcacagtctaagggaaattaaaacgatttgctaaataatcaactcccaggctaaaggaaaaggaaaacagtgtttggttttggaagcaattctctaatcacatttgaacatgagtgtatgtgatggtcagggaatttcaagggaactaataaagacaaagcatcagtgagactgcattgaggacatactgccatgttatccaacagtgtttactaggaagggcagtcctccgagctggttatagatgcctggcttccatcttttgtaggagtagagtgaaatttagatctacattcatctaaatttataaagcacctctggataacaccctggacgctctcatgtaagcctcagaacaccttgtgagttgggtattagtattcccaccacctcacagaagagagaataacataccatagtcatagagtgaagaaatgaataattcagaaccccaaaaccctatcctctgaccccaagcttagctccttcactaagcggattcccggaatttaactgaatttgacctttgtattggctggctaaggggaagaccaaatcttcctttttatcccatttatgagtaggaggttgcacaggggaggaggggtaatggctacaaaagaataaaaagtaaaccaaatatgctagggttttctcatcctacagatgacatacgagctggctgaaaaactgaacagaggcagaacttgagaaattttggggagaaggacctaaaaaagtaaggcagaacaacaacagctatgatgacaacaaaaggactcataaagaacaaggtggatctcagctcaaaagctccttcagctgataaacaacttcagtaaagtctcaggatacaaaaatcaatgtgcaaaaatcaccagcattccaatacaacaacaacagtcaagccaagagccaattaagaacgcaaccccattcacaactgccataaaaaggaatacatctaaccagggaggtgaaagatctctacaaggagaactacaaaacactgctcaaagaaatcagagatgacacaaacaaatggaaaactttcccatgttcatagatagaaagaaccaatactgttaaaatggtcatagtgcctaaagcaatttatatattcaaggctattcctattaaactaccaatgacattcttcacagaactagaaaaaaactattttaaaattcatatggaaccaaaagagcccgaatagccaaggcaacactaagcaaaaagaacaaagctggaggcctcatgctacccgacttcaaactataaatacagggctacagtaaccaaaacagcatggtgctggtacaaaaacagacacatagaccaatggaacagaacagagaacccggaaataaggctgcacacctacaactatctgatctttgacaaagtaggcagaaacaagcaatggggaaagaactccctattcaataaatggtgctgggaaaactggttagccatatgctgaagatcgaaactggacccttcctcataccatatacaaaaattaagtcaagatggattaaagacttaattgcaaagctataaaaaccctggaagacaacttaggcaataccattctggacataagaatgggcaaacatttcctgacaaagatgccaaaagcaattacaacaaaagcaaaaattttaaatgggatctaattaaactaaagagcttctgcgcagcaaaagaacaagacagtgaagaacagagtgaacagacaacctaggaaatgggagaaaattttgcaaactaggcatctgacaaaggctttatgtccagcatctataaagaacctaaacaaatttacaagaaaaaaaacaaacagccccattacaaagtgggcaaaggacatgaacagacacttttcaaaggaagacatacatgcagccaacaatcaaaggaaaaaaagctcaacatgactgactgataattagaggaatgcaaatcaaaatcacaatgagattccatctcacagcagtcagaatggttgtcattaagtcaagaaacaacagaagctggtgaggttgtggagaaaaaggaacatttatacactgctggcaggggtgtaaattagttcaaccactgtggaagacaatgtgccgattcctcaaaaacctaaaaagagaactgccatttgacccagcaagcctattactggagtacatacccaaaggaatataattcattatatcacaaggacacatgcatatgtatactcattgcagcattattcacaatagcaaagacatggaatcaacctaaatgcccatcaatcgtagactgcataaagaaaacgtggtacatatacaccatggaatactatgcagccataataaaaaagagaccatgtcctttgcagggatatagatggagctggaggccattatcctcagcaaactaacacagcaacagaaaaccaaatgctgcatattctcacttacaagtaggagttaaatgatgagaacacacaggacacatagaagggaacaacagacactggggcatactgatgggtgaaggatgggaggggtgagaggatcaggaaaaataactaatgggttctaactaggcttaataaataggtgacaaaataatctgtgtaacaaacttctatggcacaagtttacctgcataacaaacttgcacatgtaccccaaacttaaaataaaagttaaaaaaaaagaacaaggtggagaaggatagaggttctgaaacttactgtgaggatgaggaaagagaaacaggcaaaccagtcactcggtgcctgtcactgttagtttactccagctggagacctgggccaggggctaacactattcaaatatgacattgtaaagaggcttgttttaaagagaggtcaggaaacttttaggtaatgataccaaaagaagaaaaaccagacacaatgctagatgccttaatatatcttaaaatataatctcctggccaggtgcagtggcttaaccctataattccagcactttgggaggctgaggtgggaggatcacttgagcccaggagtttgaaacaagcctgggcaacatagtgggactccatctctacaaaaaacaaaaacaaaacaaaaaaacagccaggtgtggtattgcatcctttagacccaggtacttgggaggctaaagtgggaggatcacatcattgtactctagcctgggctagaacctgtctccaaaaaaacaaaacaaaaacaaaaaaacaaacgtaaaatacaccattgcactctggcctgagctagaacctgtctccaaaaaaacaaaacccaaaacaaacaaaaaaccaaacataatcttcacaacctggtgaggcaggcataattattcctatgaagttaaaactcagaaaaattaggtaacttgcccaagtcacactggttaggttgtaatttgagctctagtctctgcggctcacaaacctctgccctcagcactatgctaggaaacctttgtcacagcccttggccataataaacagagcagccagagcataaggccatttaacccacagaatctgaaggggtgctcatcactttccatgctttatgtcacctcagtgtgaggtaacatacattctgtcactctggacttccacaatgcaatgtggcatcattagaagtgaagaaaaggctgtgcaggaagagaggttaaaatgtttagaaaaatttatttaaggaaataatcaatgaaagcttcccaagtctagcaagtgtgtcagatatccagatacaagagacccaatgacccccaggtgaatacactgcaaaaaggacttcaacatagcatactataatcagaaggtctaaagtgaaagtaaaagaaacaattttaaaataagcaagagaaaagcatctagtcacccataaaggaaacctcatcagactaacagtggacttttcagcagaaaccttaaaggccagaagagaatgggatagcatttttaaagtgctgaaggaaaaaaaccctgtcacccaagaattttatatcctgctagaataagcttcataaatgaaagagactagtctttcctagacaaatactaatggaatctgtcaccactagaccagccctataggaaatgctcaaaggagtcttaaacatggaaacaaaacgctgatattcaccatcacaaaaatacccagaaatataaaactcacagttcttataaaacaatctcacaaaagaggaaaagaaagaaatcaaattacagaatttcatcaaaacacaaggacaaaaagagaaaaagaaagaaaacaaagaatttataaaataacttgaaaataaccatgtgacagaaacaaaacctcacatatcaatattaactttaaatgtaaatgcattaaatgcttcatttaaaagatacagactggcagaatggattaaaaaaacataatccacctatatgctacctacaagaaactcaccttacctgtgaagacacaaatagactgaaagtaaaggggtggaaaaagatattccatccaaaaagaaatcaaaaggagaactatatatatgtcaaataaaacagactctaaatcaaaaacagttaaaaaaaaaaaaaaagactaagaaggtcattatataatgataaagggatcagttcaccaaaagggtacagcaaatcctaaatatatatgcacccaacataggaccacccaaattcacaaaacaaatattactagctctaaagaaagagatagatagcaacacaataacagtgggggacttcgacattctactcacagcactatacagaccatcgaggcaaaaaattaacaaagaaacactggactttagaccaaatagacttaacagacatttacagaacattcttcccaacatctacagaatatatgttcttttcatcagcacataaaacattcttcaagcatgggctacatagggagactttgtctctacaaaaaataagattaaaaataaatgtagccaggcatggtggtatgtgcctgtggtcccagctactcaggaggctgaggtgagaggactgcttaaccttaggaggtcaaggctacagtaagccatgatcacaccactgcactccaccctgggcaacagagcaagaccctgtctcaagaaagaaaaaaaaaaaaaaggaagaagaaacattcttaaagatagatcacacatcacacattaggctacaaaacaagtcttaacaaattttaaaaaatcaaaatcaagtatcttctcagacaatagtagaataaagctagaaatcaacataagaggaacttcagaaatgatacaagtacatggaaattaaacagcatgcccctaaataatcacttaatcactgggttaatgaagatttttttcccctgagacccctgagacagggtcttactgtgtcacccaggctgtggtgtaatcatggctcaccgtagcctcaaactcctttggctcaagtgagactcctgcctcagcctcctgagtagctgggactacaggcacataccaccatgcacagctgcacagctaatttttttgtagaaatggggtttttccacgttgcccaggctggtttcaaactcctaggctcaagcaatccacccacctcagactcccaaagtgctgggattacaggcatgagccaccatgcctgaccttaaaaatttttggaaacaaataaaaatgaaaacacaacataccaaagcctgtgggatgcagcaaaagcagtgctaagagggcattactaatgtttacagcattacatgtctacataaaaaagtaggaagatcacaaattaacaacctaatgccatacctcaaggcattgaaaaatataacgaaaactataacaagaaaaaaaataactaaactcaaagttagcagaagaaaagaaataacaaagatcagagcagaactaaataaaatggagaccaaaaaacaatacaaagtatcaacaaaatgaaaagttgggactaggtgcagtggctcatgcctgtaatccctgcactttgggaggctgaggctggcggatcgagattctaggagttcaagaccagccagggcaatgtggcaaaatctcaccttgacaaaaaatacaaaagttagccaggcatggtagtgtgcactgtagtcccacctacttgaaaggctgaggtgggaggattgcttaagcctgggaggcaaatattctagtaagccatgattgtgccactgcaccgtgtagcctgagtgatagagccagaccctgactcaaaaaacaaaaaagaaaagttggttctttgaaagatacacaaaattgataaaccactagctaagactaagaagacaagagagatacaaataaacaagatacaagacaagaagagatacaaataaacacaatcagaaatgaaaaaggagacattacaactgataccacagacatacagaagatcatcagagactattataaacaactagatgtccacaaactagaaaacccagaggaaactgataaattcatggaaacataatcttcaagattgaaccaggaagaaacagagtatctgaaaagatcagtaatgtagtagcaagactgaatcactaataaaaatctcccaagaacaaaaagaagcccaggacctgatggagtcacagctgaactctaccaaacacagaaagaatgaataccaatccttctgaaactattctaaaaagatcaaggagggaattctccctaactcattctatgaggccgctatcaccttggtaccaaacagacaaggacacaacaccaccaaaaaagaaaattatagaccaatatccctgatgaacacagacacaaaaatcctcaacaaaatactagcaaattaaatccaacagcacatcaaaaagagaatacattatgatcaggtgggatttatcccagggatgcaaggatggttcaatatatacaaatcaataaatgtgatacatcacataaacagaattaaggacaaaaaccacatgattgtctaaatagatgcagaaaaagcattcaatagcctgggcacagtgacttatacctgtaatcccagcactttgggaggccaaggtgggcagatcacttgagatcaggaattcaaggccagcctggccaacatggtgaaactccgattttactaaaaatacaaaaattagccaggcatggtgatgcatgcctgtagtcccagctactcgggaggctgaggcagtagaattgcttgaacccaggaggcagaggttgctgcgagctgagattgcaccactgcactctagcctgggtgacagagattccgtctccagctactcaggaggctgaagggggagaatcgcttgaaaccaggaggtggaggttgcagtgaggtgagatcgcgccactatactccagcctgagcaacagagtgaggcagttgctctgtctcacaaaaaaaaacaaaaaacaaaaaacagatgttggtgcagatgtggagaaaagggaatgcttatacactgttgaagggaatctaaattagtatagcctttatgggaaacagtatggagatttcttaaagacctaaaaatagaattaacctttgatctagcaatcccattactatgtatacatccaaaaggaaagaaatcattatatcaaaaacaaaaacaaaaaaaaccactcgtatgtttactgcagcactagtcacaatagcaatgatatggaattaaccaaagtgtccatcaatggaggactggataacaaaaatgtgtatatatctacatctatatctcaccttgaatactacttagccataacaaagaatgaaataatgtcttttgcagcaagatggatagaactggaggccacgtgtataagtgaaataactcagaaacagaaattcaagtatcacatgttctcactttaagtgggagctaaacaatgtgtatgcatgagcatacagaatagaatgacactggtgactataaaaagtgtgagggtgggaggagatgagggttggaaaattacctattgggtacaatattcactatttgggtgatgatgggtacactaaaagcccagacttcaccatgtaagaaaaatgcacttgtattccttaaacgttttaaaaattaaaaagaaaaaaaagtgaaggggaagcaagcagtaagcactcaggggaagcagcatcagcactccagggccacaaggacagctgagctgtgggttctgtgatcaactgccctctgctggtgagtagaaataatgagtggaaagaggaccaaaggctcatttcaggttgaaggtgtcaagaagatctttttcagccttttattagagaaaaattcaaacttaaataacagacagaagagtataaaacagccccatgcatctttacctagctttgacaatatatcagctcatggccaatcttgtgtcatctacccattacccactgccctctgccatgttttattttgaagcaaatcccagacaacatatcattgcatctggaattattttagtatgcatctctaaaagaaagggaattttttaaaaagctccataacaccaccattgtcacaactgaaaaataattaacaataattctaataattccaataattccttatagcatgggacgccaacaacaaaacaaatcattaagcctcacccaaggaggatcatggcaagggaaaggcaatcatgcaaaattcagattaacagcatgaatcacccaaacaaacaaaagtacctcatcttcagtcttgccagagtaaactagcaggaacatagattaaatgaatatcttaactggaaatgcaaagccatgcacccaaatggtaggaaaatctttagttcagcagatgtgacacaagtgctactaagtctttgttgaaacttttatacaatgtttttattattataattttttttttttttgagacagggtctcactctgtcacccagactgaagtgcagtggtgcgttcttagctcaatgccgcctcgacttcctgggctcaggactacgggcgcgcaccaccacgcccagcccttttttttttttttttttttttttttttgagacgaagtctcactctcgcccaggccagaggcagtggcacaatcttggctcactgcaacttccgcctcccaggttcaagcaattctcctgcctcagccgctcaaaggtgggactacaggcatgtgccaccacgcccagctaattttttgtattttagtagagacggggtttcaccatgttgcccaggctggtctcaaacccctgagctcgggcaatctgcctgtctcggcctcccaaagtactaggattacaggcatgagtcaccacatccagcctattttttctatttttttagagacagggttccaccatgttgcccaggctgatctcaaactccaggactcaagtgatcctcctgccttggcctcccaaagtgctgggattataggtgtgagccaccgcatctggcctatttttgttatttttaaagagacagggtcttgctgtgttgcccagactggtcttgaactcttgagcccaagcaatcctcccgccctggcctcccaaagtgctgggattataagtgtgagccaccatgcctggccttgttgaatctttccagtgattcaggagggcaacacggtccttgagggccaaatgctcagaggagtatccaagcagctgggctatgagacactgagaggtgtgaccataccagctccccagcaatctcaaacccagggattagaattaggttgaaagatcactcccctttttgggctacctctgtgctatttctccctctcttgcaaatttctgttagcatgtctcttttcccttctaaattatacgcctctgcaagtcagtatagcatttgatatggtttggctctgtgttcccacccaaatcttaccctgaattgtaataatccccacgtcgtgggagggacctggtgggaggtaattgaatcacgaaggcaggtctttcctgtgctgttttcataatagtgaataagtgttacgagatctgatggttctataaaagggagctcccctgcacatgctctcttgcctgccgccatgtaagacatgattttgctcctcattcaccttccgccatgattctgagacacccccagccatgtggaactgctaatcaattaaacctctttcctttataaattacccagtctgaggtatgtctttattagcagcatgagaacagactaacgcagcgttgtgttcacttttgtatcccgagcagctggcacatgagagatgctcaatggatgcttgcatgaagaaagcctgaactagaaaagtctatcacttgatgatgccaaatgttggaaaaaatgggaagaaaagagtattctcctactctgcttgtgggacgatgaactgatacagccactttgtcctccaaagagatgtcaaatatttaggccataaaacaagaataggatgcaaaaaacaggagcattcagagaacagcaagaaaagagagagttcctggaaattataaacactcaacagaagggttggaagctaaagttgagaaattcgagaaaatcttccaaagcagagcaaaagaaaaacagataaaaaatagaagacaaaagaaagaaaaccaaagactaatctagggggtgcaatatctgaataaaaggagttccagaaagagaacagagaaaacagatgggacaaaattaaagaaaaaatttaaaacatttttcttatatgcttatattctgagtttcccaacagaaagggcaatgaattcccggtaaaacagataaaacagataaaaacagactcacatcaaagcacatcactgagagaattcagagcactggggaaaaataaagacctaacatgcttccagaaataacatacacaaaggattaagaatcagattggctttagacatagacaacaatcctagaagtaaaagataaatgcagcaatgatctcaaaattttaaaggaaagtgatttctaatcaatacccagcctaagtattaactatgggtgaagacagacaaaaaagactttcagacatacgtggtctccaaatgtgccttccatgttccccttctcaggaaattactggaaaatgtgcttcaccaaaatgagagtgtgcaccaagcaagtgaaagacatgagatacagtaaatgggggaccccctagaggggacagcgaagacactctccatgagagaagaacattatgcagggaaggaaaggtgtactctgtggctcaccataccatcaaactgaaaactaattagccaaaaccaccagacaactatattaggaggacagagggatgggagggtgcgtacatttgatgagggtgggtgccagagttgacttctaacctcccatagagagaagtcaatagatgatacctaaagttgaaacgtagagaaggagcaacgaaaacttaccatttagagaaatggcagtaacaacaaaaataacccactaagacagatggaagcagttgtctcagagaaggggaagaggagggggagcacagatgctgctgtttttgcaatcctatgcatctgtaactttgataaataaaacaatatgagggaaaaaccctgcacacaggaagtgtctcagaaaattcagaagggcagtaaagcttccaacagcactgccaatggtctgacattgttcgaccaccaggttctgctgctgttatgcctgtttgtaccttactgcaatatcccagtttatggccatcaaagctcagcatttcacaagcacctaaaagatacaaagctttacactgtaaccaagagtgtggaagccactcagtcagcaggtatgttacacacggatttccaaagctcttaccagcagtaaaaatgcctttcgtgctctgtcttatactagacggtctcacgattgctgaaagccctgcgagaaaaaaaccaaaaaggagaccaaaaaaacccaaaacagatgttagtcatcttaacagttttaaaacttgaaactaaatattctttctagtcagccaatcaaaccaccaaatctatctctgtcctgctgtcacagtgacaatgaaaagggcagtgggattgagggccaggagaccagagcagccagccgtggcgccacccggctgtgtgagtccaagccgatgaccgaacagctctgtgcctcttccccttaaaacaaggggatgggttagctgaccctcaaagggcattttatgacttaaatctgcttgagatttctggttctcaattccataacatgaaaagataaaaaccaaatgattacatctacgagaaaaactttcattctgaaaacacacatacggattccacagtgaggaacaagtttcactcacctcaaagagacggcccagatcacactgttgccaggatcatgttcaaacaaacaacagtgtgcctcgtacagagctatcttcaggatggggagctggtgacctaaacacacactctgcaaacctagtgcaggcccaggaggagagtgggcgtggagcgcctgctgcagctcatccactgcagtgcgatggtctttgcaaagcattactggaaattctatctggcacgcggaggagctcagtaaatatttactgaatgaaaacaggagaatgcactcaattgacagagggactcattctcaatttcataaatatttcttgattgactgatctcataaattacctttagcaccttaaagggaagttagtctctgaagataaggttcaggctcttttttttgtttgttttttaagagatacgggctgctctatcaccaagcctggagtgtagtggtgcgatcctagctcattgcagcctccaactgctcaagcgatcctcccacctcagactcccaagttagctgagattataggcatgtgccaccatgcccagctacttttgtaatttttgcagagacagggtcttgctctgttgcccaagctggtctcaaactcctggcctcaagtgattctccctcctggacttcctaaagtgttgggagtacaggcgtgagccactgcacctggcctgggttcagagttttggataaacatcagggcagtgctggggaaaatgctgtggaacgtgggccatgtctgagggaatgtactcaacaatgtatgagacacatcaaatggagttgattgaggaaagctgtgttctcgatgttataaaagcacaaaaaaatgccaccaatctcttttctcagaccaccacaaaacacagacacatcttttaaataaattctagaagttgtgctctaggaaccaaaagaaacattgtttctccctttgacagtgatttaggatccaggaatttaaaaacagaagtattttcaccatcttacttcaaacaaataaaaatgcagatttagaaaaccctcaaatttttagtgctttcttcttctgagaggcaatctctctatctcgctaaacaaaaaggaagaaataatacattccaatcacaaacaaagtctgcttttccccatggctggcatttcctcaacatcaaattcataaacgtacctagtcgcaccacatctccacagtcgggatcatgagccacttggaataaagtttcttccacatctctgttttttccaggagggtccataatatgatttatctgttgctgtaaggttttgggcaatgtcatcagctgagtgaactgtccttctgggcttttatctatctgaagggaggaaaaaaaagacgacgtctatggaagtgctttaaatcctacaaatactccaaaactcagggcttctctttaaaaatcacacaaacatatatgcacccacacccctggcgaggcagcaagctaaggaaactctctttttctgaaactgaatgggtaagtgttcaggagtctaagtcccttcaaaaaggacaattcttgtcctataatattccatttctacctgagaaaagaatagaagccactctcaaggatcaatttctgacttttggttttaaaatttatatttgtcttaaatccagcagtcaaaggaagtggtgctgcagttgacactcgtggaggccgcgtcaaatccaggcactgagatgacccctcccatttcaaacacagggagactggcgtgccctgatcacatcaccaatgagagtaagtgggatctgaattgtgtctcctgcctgtagggccttttagtatgctgtatttcacaaactgtaggaatacactgatgacagaaactaatcttacttacttttaatccccagcacacagtaggtactcaaaaaacaataaggaaatgagtaactgaatcaatacaacttagttgtcctaaagctactatgccagcggcttcggttcccaaagtattctaaaacatactaaggtgctgaagataaatatataaataaaacatgtaaaactatgtgtcagactttactcagaaacccttgaatcaaaagttagccacagagctgaggccagacctagctttcctaactccaagtttcatacactgtgcctcgtggaatgaatttttaaaaatcttgtaaacattgatttcctgccaagtgcagaaccagtaacactgccctcaacagcccatcacattatttcccaaggaagaatctgtcttgtatccttttaacaaatatttaggttttaacttcaactaagagaagagtaagaaaaaatcagatcaatgtattacattttaggcttagagtttacagataggacgaactttcttaataattagaatccactcattctaccattttttaaattgaataaatatttattaagtacataccaaatgggccaggagcacaggttcacacctgtaatcccaacagtttgggaggctgaggcaggagaattgcttgagcacaaaaattcaacatcagccctagcaaaagagtgagatatccggctctacgaaaaaaaaaaagaaaacaaaaaaaagccagacatggtggtgcaagcctacagttctgtctacttgggaggctgaggtgggaggatcacttgagcctgggaagttgaggctacgatgagtggtgattgtgccactgcactacagcctgggtgacaagaccaagatggtatcaaaaaaaacaaaaaagtatataccaaatacctgaattttctagttttgtctataaactctatgaagagaaggagaaaaatgttattatttaatggctccataaagctagaggggtaaatatttaggtttttatctaaatatttgatatttatcactaggatggttctaaattcacaggccccatcctctacttagctttggctacaaaaatgacaacaaatttgagtatttatgtaaaataatcttagaaatgacatttatggacttatgttttgaggccacatattgggattagttagaataaacttatatttaagttatgctttacctatgaagcttccaacggcttgagtgacatataaaaaaattagaaagtacttatctgccactgctttctcttgaggaaaataatgcactggaattttcacttgaaagcatgagtgtaaagataaaataccaggtgacatgatttaaaaatttggtaaattctcattttccttacactaactctcattaaaataacgaaagtgaaagcattcagctaaactgtgaaagtcaaattgcattttaaaagcggacatggatacaattattatatgtcaacttaagaaaaaagcagatatggaaaaaactttatatgattccatgcatatgaactgtccagaacagaaaaattacagagacagaagtggattagtggttgcctgggtgaggggagagctggggacggctaaagggtatggagtgacagaaatattctaaaattacattgtggtgatggctgtgcagctctgtgactatactataaacactagcttttatggtgtatgaggtattcatcaataaagctaatattttgttattattatttttgagacagagtctcgctctgttgcccaggctggagtgcagtggcgcgatctcagctcgctgcaacctccatctcctaggctcaagtgattctcatgcctcagcctcccgagtagctgggattacaggcgcacaccaccatgcctggctaatttttgtatttttagtagagatggggtttcaccatgttggccaggctagttttgaactcctggcctcaactgatccacccacctcagcctcccaaagtgctgggattaaaggcatgaagctgccattctctccccctggccaaaagagtaaagaaaaaataaaaccatatcccaggacgaatggcagagatgagcaccacctgtagacctaaaagatgcaagggtaaggcagataattttatgtgtcaactcagagcagtggcacagcctgaagacactgtcctgcgaggatgagttgtgctacacatcctgaatcaatcaccattacgctgtactatattcccaactggcagaagacatgggcctggggaccaagggtagaaagagaagtgaccttgcttatcgtcattcccagggacccacttgggaacactttgcttcctatcactacagctctagatctgtgggtctagaggtcccagttcccagagaagggatgcttctaccagaggacatagtaagcatcccattaactttaagttacgactgccacccaattaatttagaatcccatgccgtaagtccagcagacaaggcaatgagtcactacactggcagaagcaatcggccctggtcatcaggagctggggtgctgatacacgtctcttagagtaccccttgcccaattttgatggttagtggacaagtgcggtagccagggtcctccagactcctccgagatgagggtctgggccaccctgtctagataagcagaagtgatagatgagggtgaagggaatctggaggagtagcagagatgggagaagatgagtctcagttgcagcctcaaggccagatacagcactgggagctgtagctcagtcccccagtcttattcttgtaagtttcctgggaaaagaaactgatgcgaaactagatcatgcaggcttttataggccatagggaggattctggatacctttatttttatagttagagaaaattcctagcccttttcccttgttcagtttctagaaagttggtagacagacacattatacttccctgtcctctagccagagaatagaagatctctggagaaattctacagacactgatatttgagatcctccaataaaacagctaggtccttggccaggtgcagtggctcacaccagtaatcccagcactttgggaggctgaagcgggcagattacttgaggtcaggagttcaagactagcttggccaatatggtgaaacctcatctctactaaaaatacaaaaattagctgggtgtgatggtgcatgcctgtagttccagctatttgggaggctgaggcacaagaatcgcttgaacttgggaggcggaggttgcagtgagccgagattgcgccactgcactccagcctgggcaacaaagaaagactccatctcaaaaaaacaaaacaaaacaaaatagctaggtctttgcctcataatcctatagtcaagcccaccagttgacaagcctgatatatcacaaagaacttccagcctgtattttagtgcctcattctttaaaaacaggccagagccaggaacggtggctcttgcctgtaatcccagtactttgggaggccaaggcaggaggatcgcttgagcccaggagttcgagaccagccagggccaacaaagtgggaccctgtctctacaaaaaaaaatttaatgtctcagatcatatgggtacaaatatatgtgtgtgtgtgtgtgtgtgtgtgtgtgtatgtatgtatatatatgtatatatgtatatatgtgtatatatgtatatatgtgtgtatatatgtatatatgtgtgtatatatgtgtatatatatgtatatatacatatacacacatacacacacacctgtgtatacacacacacacacacacacacacacacataaaaaaatcagctgggcatagtggcatgggcctgtagtcgcagctcctcaagaggctgaggtgagaggatcacttgagtgcaagagttcaaggctgcagtgagctatgatcatgccactatactgtagcctaggtgacagagtgaaatcccctctcaaattgattaattcattaattaatttaaaaaatcaggccaggaaggaaactcagacatttgaaaaaagcttctaacataacagactagagtaaaaacagacaagaggaactaagagaaagaaaacagtgtgagagaacaagacaaaatcttcaaaagttataataaagatcattaaagagattaggagaaaataatgcatccataatacaagaataggaagctataagaaagaacattttgggaaaattaaaaatttagtagaagtgttagaaaaccaatcagaaatattctcccataaagctaaatttaataaacgaagagacgagagagagagagagagagaaaggaaaaaaggttaaaccaggaggtctagcaaccacctaacaggaatcccaggaagaacaaactaagaaaatgggtatgaagaaataattacagaaataataaaaaaaattccttagaattgaagcttataaaattccagatagaaaaggcccactgaggctgggcgctgtggctcacaccagttaacccaatactttggaagaccaaggtgggaggatggcttgagcccaggagtttgagaccagcctgggcaatatggtgaaactgtttctactaaaaacacaaaaaccagccaggcgtggtggcgcgtgcctgtagtcccagtagttactcaggaggttgaggtgggagagtcacttgagcttgggagtttgaggtcgcagtgagctgggattacgcctctgcactctagccagggcaactgagcaaggccctgtcaaaaaagagaaagaaagaaaagaaagaaagaaagagcccaccaagtgactgaataatgaatggaaaacagacataaataaagaaggaaaattatctccaccctagaatttgatatctagccaatactatctatcaaagggagggtagaattttcagaggtatatagtctcaaaaacttgcctccctcacaccctttaagaaggtaataaaagacaaacttcactaatatcagagtataaaccgtggaagaggaaaatgcaagacccacaaaaccaaaaactagcacgggggaggcaaagggaattctcagggtgataatgaagggaaggtggaggagtgcggctgtgcagtgagctagaaaacaaccagttgagaaaggaacagggcagggggctccaggaaaaacattcctgtgagaaacaagaaacagaaaatacccaataaatctgtctataatgggaagagttttacggatctgtcaagagtttgaggatgactgacctaagcaactgaaaaaataagacaactattaactccaggagaaacaaagttgtacaggaaaaggaacttcataatgccacagctcatcaataaagaaaaggctgtcacaataaaataaacattgaatattaagctaacaaaaaatatgaagtaactttatgtgaagcatgagggcgtgaggtagaaggggaagagaatgtgtgtgctaagtgcatgtgtgtgagtgtgtaattggtataagaattgatggggtagtgtaagacggtaaaaaaaatccccttcttccaggatggcaaaaataaagtgtaagattgaaaaaaaatcaagaaataatagtcgaagcatattatttagaacatggaggtgaatatcagaagaatcagctatagagacgaaagcagctgcctctggtaagcagggctgagaatgtgggaacgtatgcagcacggaactgctctttttgttataaacttgaggtatcatttggcttttaaatcatgtacatgcataaaacaaaaaacctcaacctgaaccaaatgtggcaaaatctgttaaactgagtggtgggtattctcgcatttcatatgtcactctctattcttttcttgttttaaaataattcctatttttttaaattccctttttagctctagaaattccattaatctattactcattacaatgttagttgcccctactatgtggatggagaagagcataaatgaagaaaaatacagtgttctttacattaaaggaaaaaaaaaaaaacctttggcccggcctggtttttattttcaaacaaacacttaatattaattgaaacaataccttgataagaaagttttatttgatatatcaaaaagaaaaattcccagacataataaacaaaacaagtggggaaagaagagaattttgaatatgtatgagcccattaatgtataacaaaaccaaacctcttcctatatgcatacaaacatatacaaaagtacacgtgaaaagatctggaagaacagacagcaggctgggtgcagtggctcatccctataatcccagtacttttggacgctggggcgggcagactgcttgagctcaagagtttgagaccagcctgtgcaacatggcaaaaccctgtctctacaaaaaaaatacaaaaattggccaggtgtggtggcatgcacctgtagtcccagctactcaggaggctgaggtgggaggatggcttgatcccaggctggggggtgttgaggctgcagtaagccgagatcgtgccactgcactctagcctgggaacagagtcagaccctgtccccccaaaaaaagaaaaaaaaacaacaacaaccagacaccaaactgtcagtacagttacctctggggagctaaatgggtctggggatggaatgagagtgatctaaaagtttattttcacttgttttgattggtaattgatagacatggtaataatttccaatggcaaaaaagatatacatggtcaaaacaagtccctctcccacttctgcccctagttcccttctccaaaggcagcctcttattactagtctgttaccttttagcattattccagatacacagaagcctatgtttacatacagtacttactttttaaactataaatgttctcacaccagtcatgctgttctacccctgactttcttcctgcaaatagcctttgtcttagaaacaatacaagctattttccacatacagttacctccagccagccttgctggcttttatacaccacttgaggattttcctgtagtatgctgccatagagctctcgaaagtgggctatattgggcttcacaatattcaacacttttgttttatcttctccaaccaccatccgaaagtcacctagttaaaacaaagagataaacacatcttccattaagaatccacactctcgacctatgaacgacgctccccacactgataccgcacgggttcactctggcaggatccctcatcagaacacttgcttttcctcctcaaaacctggacactttaccccaagaaatgtgagcacttgtttggaggaaaagagggtctctcaaatcacaaagccctttatgccagttaaattatagttacctagttacacaaggtaatcacaagcgagtagctaacttgttttagcttttccaatgcagaagcttctgtacctacaaagtcttgtcttatgggccaaattctgcctgtggccaatgaaggagataggagctgtgcaccatcactgtagacttgtccttgccattgcttcctcatcgttgacctgtctgtttatgagggcttttgaggcacttgatgaatataatcttatcatattttacaaaggcaaaataaggcttaaaagttctgtaagaggaggtttgcatttaagatgaaattgaaaacagatataactttttaaattgcaagtgatgagaaatgaggaatgttacatttgcctatgggatgaattgagctgaaaaacacctaattctgaaagacaaaagcatttctgaatcaaatgaaaagtgccctgccaatgccactgacaaccatcggcaagatggaggagaaaggaatgggaaagtggacacacttaagtgcatgcctactgggctaatgtgaaatcacaagaggctggacacacgcagaaccttctgagtcaagcgtggtgaaagcaatgtggctgaatcctttgttggagagggagcaaattgtcagggggagtagagaggtggcaagtgtaggcagataacccagctgctgaggaatcccctggggctaggatgacaatataatttatcatccaaactaggtcacttctgagggtgaagggatcgctataaataatcacactacgacaagtataaactgagcaaaccaggacatatggttaccctcgccaatttcttttttctggagaggggaagggatcatagaggtcattatttgccacaatggattttcctagtgcaaactgttggcttgttttagaaaaagtaaaaatacaaggaagaccaacaatatgtacttcattgagtaaggaataaaatatgctaggttttaagcttcaaaggaccaacttacactacaatttggtggaatgcaactggggactgcaagcttagaaaaacagacttccaggctgggcgcggtggctcacacctgtaatcccagcactttgggaagccgaggcaggcggatcacgaggtcaggagatccagaccatcctggctaacacagtgaaatcccgtctctactaaaaaatacaaaaaaattagccagacgtggtggcaggcgcctgtagtcccagctacttgggggggggccgcaggagaatggcgtgaacccaggaggcagagcttgcagtgagccgagatcgcgccactgcactccagcctgggtgatgaagcaagactccatctcaaaaaaaaaaaaaaaagacttctaaagagcctctggaacccgatcttggtgtacagggggtctgactgttcaggtgagtgagcagaagcgagtcccagtcctaaaaatctgctcaaatatggatgaacttgtttttgtcactattattttgaagggaaagagagttagatagttaaaacctgggatcactgctaatgaggaggttgagaaatcagtcctttcacatattgctgttgactgcataaactgctaaaattcttctggaaagcactgaagcaagaaaccccatctctggagcaagcttaaagaaataagccagaaacacagagtaagacagaaacacacaggtaacgtttaccgagcatctggtaaataccagccactgtgccaagtgtgttgtggtattgcttcatttaatacacacagctctcctctcaggtagataggattctatccccattcatacacaagggaacaaagacagtgattaagaaacttgcgtaaggtttccaggaagtaaaaatatactacatatataaaattgctcactgaagcactacttataatactgaaagcatcccaaatgtccaacaacaggggaaagaatgcactatgatggcatatggttactatcacagacagtaatcacacacaacaagatggaaagtgatcatttaatatgcagtaagaaacaaagagatacaaaagtataacaggctgggcatggtggctcacatctatagtcctagcactttgtgaggccaaggccgggggaatgtttgagctcaggagttcgagaccagcctgggcaacatagcgagactctgtctctatgtaattttttttttaagcataccaaaacaaaaaaaacttcataaaaaatgagaaaaacaagacaaagagactatataaaaatgcttatttttgctctaataaaatacatttattgtgggtttttgcatgtgtgctttaatttgctatctcatttggtcatggcaaagctccataaaataagtactattattcttaattttacagatgaggagatggacgtgcaaagacaacatgccccaggtccaactgcctctcggtattagggtagtgaaattttaggtgatgattttactctataatttccccccatttccctcacttctataatgctggcatattactttctagcattttaaaacacatttatgggatacacagatgatgacgtgacaaatgtgaatggagtggtggctgagttaacttccaactgtgtaaatccttacacgtataaaaatggattccattaatctttgaagagatgaaatgtcatcaaattctgactctaacaaggctggccctgaagtgaaagatcagtttctaaaactgttgaattctaaatatttgtgtcattccttctttctgtacattccacaaacaaaaagttcctcaattttagacagtcactttctgagagaaggatttaccattttaaaatatcaaggattatgttttacaatccaaatcttccccctaaaagaacaattgcatgccatgattaaaggacctagaaaacactccaggctctcggagaacaaggaccggggcttatttatgtctgcatccttagctccttgtgcactgcctggcacagggaacacatacatcaataaatgtgtgcagaactgaatttctctcactggtgtgcagctgaactagctcaaccgcaggggataggaagcaaatgggcttatgactcatttcttcagaacaaaatgaataacatcatgggcacagcacgaaccagcatctgatcataacaatcaatttttcttaccttgggagatttgttttcaacaaaactacagcaatggattaaaactgactgctgactttattttatgcctctagaactgccagtacaataggcatccaaaaggatttctccttgaccttgaaatgatacaaactccaaggcctgcaagccacctgtaggtggccttccctgtgattcaggcatgcagccagcagtcagggacctcattacaagtatgcagatgtgaagggctgcacagtacagcggcaaggccctggctttcaagtctggcaatgtcccagggtgactgaggtcaagttacttaaaccttctgagtccttcactgtaaaatggcttaatcacactaaccttacaaagttgctttcagatttaaggagttagggcagcagtccccaaactttctggcaccaggaagaggttttgtggaagacaatttttccatggatgtgggtccaggggacagtggtttcaggatgattcaagcacattacatttattgtgcacttcatttgttattattacattgtaatatataatgaaagaattatacaactcaccataatgtagaatcagtgggagtcctgagattattttcctgcaactagacagtccctctgggggtgatgggagacagtgacagatcaggcatttgattctcataaaaagcctgcaacctagattcctcatatatgcagttcaaataggtattgcgctcctataagaatccaacgcagctgctgatctgacaggaggcggagctcaggcagtaatgcaagtgatggagattggctgtcaatacaaatgaagctcgcccaccactcacctcccgctgtgcgtcctggttcctaacagggttcccaagggttggggaacccagagttaaggtattagagaatgctttgtaagtagtaaagcagatactacttatgatatgtatatagcatagtcgaaggatggagggtagaggaagcgctgggtcttggagataataattaccggctaacttttctccctttaaacgaattgcaagactgctgtcatttcagttcagtgaatatctgagtggctacaaagtaccaggagctgtgctaggcaatggagatccaggttgggcaaccctaatctgaacaccgaaaatgcaaaatacccccaaacctggaaaccttttgagcactggcaggacaccacaagtggaaaattccacacctgacctcatgcagtgagtcgcacatattattaaaaatatcatataaaatcactttcaggcgatgtgtatgaggtgtatatgaaacataaatgaacttcgtgtttagacctgggccgtccccaggatatctcattatatatgtgcaaacataccaaaatctgaaaaattccaaaatctaaaatacttctggccccaagtatttcagataagggatactcagcctgtccagatataggctctacctcaggcagcaaacagtatgaaaaaaagatcatttcagtgcagttttttatgtggtagtgtttaaggactgcagcccaaactggatattgatatggcaaaataatattcattttcatgactgtttttcagatataattcacataccatgtaattcatccatttaaagtaaataattcagtatttttaattctgtttacagagttgtacaatcatctctccaatctaatactagaatattccagcctccctacaagaaaccccatactcctaagtgatcactccccaactcccttcattccccatccccagcctgaatttaaacattgctgtcattttggttcagtgaatatttggctggctacaaagtaccaggagctgtgctagacaatggagatccaggttggatctaatctactttcttgccacagatttgcctattctggacattttatacacattgaattatacactatctggagttatttttacgaccttagcaaaatgttttcaagggtcatcacactgtagcatttatcagtacttcactcctgcttatggttaaataatagtccatcgtacagatgcaccaattttatttatccatttctcagttgatgaacatttgtgctgtttccacttttgggcgattcattatgaataatgctgctacgtacaagtttttgtgtggacatatgtttcatttctcataggtagatatataggagtagaactgctgggtcatatggtagctatgtttaacatttggaggaactgccaggcttttttccaaagcagctgtaccactttacaatctaatcagcaatgtatgagggtcccaatttctccacattctcaacacttgttcttgcctttcttttttatcacagccattgtagcaggtatagaatggcgtctctgtgatttgtattgatgtttccatttccctaatacctatgatgtttaacaacttttcatgtgcttactggccatttgaataccttttctgaagaaatggctattcaaatccttctcttgtttttaaactggattgtcttttcattgttttgttgttgttgttgtttttttttttttttttttgagacagagtcctgctctgttgcccaggctggagtgcagtggcatgatcttggctcactgcaacctccgcctcctggggtcaagctattctcctgcctcagcttcccaagtaactgggattacaggtgcacaccaccacgtccaactaattttttgtattttcagtagagacagggtttcaccatgttggccagactggtcttgaacccctgacctcaagtgatccaccagccttggcctcccaaagtgttgggattacaggcgtgagccactgcgcccggcctttccattgtgttttaaaaattctttatatattctggatactagtcccttatcagatgcatgatttgtaaacattttcttccattttgttagctgcctttttactttttttttttttttttttagacagagtctcactctgtcacccaggctagagtgcagtggcatgatctcagctcactgcaacctctgcttcctgggttcaagctgttctcctgcctcagcctccctagtagctgggactacaggtcaggtgtgtaccaccatgcccggctttttttttttttttgagacagagtcttactcggtcgccaggctggagtgcagtggcatgatctcggctcactgcaacctccgaatcctggggtcaagctagtctcctgcctcagcttcccaagtaactgggattacaggtgcacaccaccacatccaactaattttttgtattttcaatagagacagggtttcaccatgttggccagactggtctggaacccctgacctcaagtgatctaccagccttggcctcccaaagtgttgggattacaggcgtgagccactgcgcccggcctatccattgtattttaaaaattctttatatattctggatactagtcccttatcagatgcatgatttgtaaatattttttttttagacagagtctcactctgtcacccaggctagagtgcagtggcatgatctcagctcactgcaacctctgcttcctgggttcaagctattctcctgcctcagcctccctagtagctgggactacaggtgtgtgccaccatgcctggctaattttttttttttttttttttttgtgacaaagtctcgctctgttgtcaggctggagtgcagtggcaccatctcagctcactgcaaccttcgcccgcccggctaatttctgtatttttagtagagatggggtttcatcatgttggccaggttggtctcgaactcctgaccttgagtgatccatccgcctccacctcccaaagtgctgggattacaggcgtaagccaccatgcctggccttccttttgtatacattagaaaatacaaaagtaggaagtaatagggaggactcaggttcactatattggttcaggaaggaagcagtataatccactcatcaaatatttactgagcacctagtacatgtcacatactattggaagcatccaaacagaaggagcaaaacaagacaacaattccttccctccacatcctcagtggtggaacaaagaccaaagatcagccagccaaccaacaataagatacagtgtagccgactgtggaaagtgctatggggaaaacacaaacagggaaagacatagggagtggtggagttgcagtagcagtcagggaaggcctccatgataagccagaactgaggcccactggggtgggtgtggggaggggaggtgtgacccagtgggtcctggggaaggagtgacctaagtgtgaaccaggagtgacgcccaccaccaaagacctttcatagaacagtgaagtgttaagagcaagcattccaggaagaagactgcctgggttcaaatgctagctcggcatttacaagctatgtgacccagggcaagccacttaacttatctgggcatcagtatcctcaaatgaaaaaggggagcaataactagtttgtacatttcagggactgaatgaatgttacaatacctgacacacagtactagtctaaaaagtttgggtattgttcatgctttctatcccttcaggagtgctgcgttctcagaaattagcaaatgactactgagtaacctgagttccggctgaggcacagagaagcaggcttccaaagtcctgaggcagtcagctcccatatgctgatacaaccacactgcttgtaaggtttcagatggcttcatcaccacagaataaatcttactagcttccactccagagaaaacgtttctttactggcttctaccagaatccagaatccacactttagagagctggcactgaatgctaatttttttccccaagaatcactcaactggcaacttcctcactgcttcgtcttattcctagaagtagctgaggctgtgttcagacaatctggcaattaaagaaacccattctctctctcataggagagtgcccgaaagtgtttttcattccatgaggaccttaaccggccagatgaaatggggctgtcatgtttcaatccatctgatctaagtactcagctaattttttttttttttaatttaagaaacagggtctggctctgttgcccaggctggagtgcagtggtgtgatcatagttcactgcagcctggaagttgggattacaggtgtgagccacagcaccctgcaaattttgacaggcattgtttgtcaatatgtaacaagttttataatttttatagctgacaacataattccactttggagaacacatccaaggaagtcagtgcctcctttgcccctttcccaacgaaagtaatctgtacaaagtgattcacagcagtgttgctaataaaacagtgagaaatggagctaatataagtgtccatcaatcactggatgattgagcaaataacagtttctcaacctgaggaaaacccatctgaccaacaataatacataaaaataataataacagcaatcattttctgaacactgactattaatgagataagatgctggaggcagccaggcgcagtggcccacacctataatcccagcactcggggaggccgaggcgggaggatcgtttgagctcaggaattcgagaccagcagaagcacacagcgagcccctgtcgctacacaaacgaaattagccagccgtggtggcgtgtgcctgtggtcccagctacttgggagtctgaggtgggagggttgcttgggcccgggaggtcgaggctgcagtgagctatgatctcaccactgcactctagcttgggcgacagagtgagaccttgtctctcaaaaaaaaaaaaaaaaaaaaaaagatgttggaagctattatacgtattatctcattgataatttctttgtgagatagttatttgttttacaaataagaaaactgggggctcagaaaggttcaagcttgtgtttcaggaaataaaataatgaaaaacaaataaaacaaaaaagaaaggttcaagatacctttagaaagctggtattcaaactagtccaccatgtaccagatgagtgaccttagacagggaaccattctgggcctcagttttctcatctgtaaaatggggcaatgatacagcacccaaatcaaaaggttaatgtgaggattaaactagttaccaaatttaaagtattgagagtagtccttggcacccaataataaaggctattttccctgccattaagccacagacttcagtcacatcagtctactgctttcctcctaaacacatcatgttctttcacatccttcttgcctttttcacacgtgttgtttttcaagtctaccactgactcactgtgactgcatgttattaatgtgaagctccttagagcagaaattccatctgcagttcttcagggtatggaatgctaatttgcttgataaatattaaaccaaggaccattgcctaaaattagtcattttaatagttgtactgacataacaaagttcaaggtgactctttaaaatgcatttggtgctcctttcctgttcatttaaatgctgacttctaagaaaaactagagttagaaagctttctttctttcttttcttttctttttttttttttgagacacaagacagtctcactgtgtcatccaggctggagtgcactggcatgatcttggctcactgcaacctccacctcgccggttcaagtgattctcctgcctcaacctcgcaagtagctgggattacaggcatgcaccaccacgcctgactaatttttgtattttagtagagatggagttttgccatgttggccaggctggtcttgaactcctgacctcaagtgatctgcctgccttggcctctcaaattgctgggattacagggccaccacagctggctgggttagaaagctgtcttaaaacagaaaagaggaaaaaaaaaaaaaaaaaaaggaggggggtggaggaaaaataataaaaataaaaaataaaaaaagataaagctttctccttcccagtttgcagcctctcatcctccacctactctcttctcacccataatttataataatactgacctcagggcagtcaaagtaatcctaaaatactatataaaatgtaaaggattgttattgctacaaataataccaatctcgcctctgcctaagtaattactggcaggaacttgtccaacaacatggacagacatggtttttctgttccttctcctgcccactcccaggaaaaatactgaacttcacagattagggaccatatataatctcacaactggaaaaagatggacaatgcaaagttataaataaaaatgagattagtagacaatatgaattttggcatattctcagggcttcggagatttgggtggtttgccaagggatagaaaccaatcaattctacaacactgggttctcagaagcctacaaaagtcaggaggaaaatgtgcctttcaacactttgcctggggtaggtctcatacctatgaaagagatctacctacagagcctatgtcattttctaccttcattactctcttcttgttccagcaaaaatcagctaaacttggtagcagcttgaaggctaaattaaaagtcttcaaagaggtgaaagcagctatgtcatttggtaaatttccttagtaatattcagaatttagaaggaactcccagaatccatccaatgctacgaagatgttgactagaagggaagaaatggaggactggtagtggtaggggcagagtagagatcagtcctgcatcttctcccaccaagtcagctttcataaaaggcttccgttccatcatttttcacaggggagtatggaaaggtaatcactctaataaagtgacttcctttgctcacacagtgtgcatgtgacctgctcattccagcacagggccacgccactctttgcccctatgtcttttgttggaaggcagggaggctgccaggtgaagctggaagcacccagagaccaaggttgcttcaacgcctttctctacagtgttgcaaatacagccgtagtcatggtagatgaattttgggaagatggaagaacaaaacctctaaggtctcttacagcattaaatttccatgaaatcttacctgtctgtactgggatttggaggctaagtaaactgcttttccaatgttctgagcataaagttctttgactcatactcaaaaatcgggaaagatgattttttttaagatggtggttttcaaactttttaaaaagcggcagagcacttgttttgtaaatgaaatcttaaacggaaccttactatagtaaaaagatagatgggggctcctctggttgcagcgagggtgagtggccaggggctctaccctctcagttgtctcagtttgggacataatatgtgtgacctaccctcaaacagtttagaaaataaatatatatatagtatgtttacacatacagagaaaacagtggttctcaaagtgggatccctggaggggcatcagcatcacttgggaacttgtttctaaaaataaaaattattgggccctacctcaaacctattaaatcaactgtctggggtagggcccacgagtctgtgttttaacctgagacttcctagttgttcagacacaggctaaagtttgaaaaccactgatacagaaacaatgagaaaacaaatatggtgcaatgttaaaattggcgaatctgggaaaagggcatagggagttttctgtattattcttgaaacttttctgtaagtttgaaattacttcaaaataaaaattaacaaaaacaacaaaattaccctgggacaataagcatggagatgtggagaggggacccaggaggtagggaggcaaatcacgaggttagtgcaggaaccactcaagagtgacgtgatttacaactaagactgtagcagctccagggccgagtgagaacaggatatccgcagtcttcaaatataaatctctcccttgtagaacatctgggcagcaaccatactaacctgaataggagagaccggcaatctctatgaagaggtcttcttcagaaaagctttcggggagcatgaggaaagcagcggtcacagcactcttcagatttctatcgagggctgatctaagagtgacatcctcgttcactgagataattttcacctgaaagaagcagaacattgggaagaaaaattccagaagtggagtattgctcaagcatgggttacaaatgcactggaactatctcaaactctcttcccactgaagatcttggaatactggttcaggtgacacaaaattgttcctctaataagtaatcccagaatctccttgttttatgccaaggtcaaagaaatcatgacacaggaaaggatcaaaatgccaaagaaaacaaatattcttcttaaatgaggaaatgcagcataggtttagaaaaagagcaaaagtcctttggaaactttaatatttttaaattttataatctcactgtcgtcacttaattttttagtcgacagaggcattttacctctttatttagacctcatctgtaatcttggaccatatctaacataggaagttcatgctctatttcgcactttctagatacatcgattttgaacttgactaaggaaaaatgaaagaaaactagctacagtagaaaaagaacgggttttagagataggtatgggctcaagtccaggtacttactagctatgtgagtttgggcaaatgatttgcatcaaagaatcgtcacaaagattgactataataataaatgtaaagtgcctagaatactagcaactgcttcgctcagaaagaatttttctcctcaatacagagtagaagcttccatctgagactttctgcaaatccattaaaatacaaagagtgactgggtgtggtggctcacatctgtaatctcagcactttgggaggccaaagcagggggatcatgagaccagcctgggcaacatagtgagaccccatctctataaaacaaaaacaaaaaaaacaaacacctagccaggcacagtgatgcacatgtgtggtcccagatactcaggaggttgaggtaggaagacagcttcagtccaggtggttgaggctgcagtgggttgcagtgagccatgatcatgacactacactccagcctgaaagacacagttgagaccctgtctcaaaaaaaaaaaaaaatactaagagcttcagtctgttctgagattcttacttttaaagattgcactgcagttaagagatgtgttcaaatgccaactccatctcttactagctctgtgactatgggcataattccttatcagtaaaatggagtaaataacagaatcaagctcataaggctgctagaaagatcaagtgagttactgcacacaaacccttcagtgaaatgagcttccttgtgtgtgcttctcagtgcacaaggcaagagcttctctgggccagcggttctcatctttagctagcattagcttcacctggagaactcgttaaaatgtgtattatcggatgcaactcccagagttctgtttcaggaggcctcggtgagggctgaaaaatgtacatttctaacaagttcttaagcaatgcccagggaccacattttgagaattactgctctaaggtgcatacttagcactgtcaaattgctcttcagagtggttatgccaatttacactcgtaccatgatcttttaaaaacatcatactgtttctgattgactttctatacaaagtaaagggtctagaagtcccttaataaggactctcatatgtctaaaatatatctaccatctctaaatcttttggtactatcgacacattttctacctattctagaaaacagggcataagttgccttttatttgtcaaatacagataatttctgacaaaattaagatagcacataaaagacacactatgagaaactccaaaataaatattagaaagcaaggaaagaggagaatgctgcagtattccaaggcatagcttcttctcttctaattgtaaaaaacagtattataaaacatataactattattttataaatcaggcttcagaatctgaattcttttaccttttttccctacttttttctaagggagtatttgtaacatacaaacatcatatatggtaggtaagccacttgattcaataacaccccctcctcccttacaattctgaggacttaatggaccttaattaagcctttcagcacttaggtgagtttagtattactgcaatcatctgcagagagtaacccatgaccagccaggaacatgacttgcctacagttgcataatgagttgacaacaaaaatcaggatcacattcttttacttggcaaattcagctctaaatattctgaattattctcatgcattcatttagggttatattctggttaacttatcttgaaagatgattaaaacaaattttaaggtcctataaaaacacctatgcttattccttgaataactttcctaaaccttatagagttggctcttcgtatctgtgggttctgcacccatgggattcaaccaatcacagatgggaaacattcagaaaaacaaaaaaaaaaaatccacaaagttccaaaaagcaaatgttgaatttgctgccacatgccaattactacgttgaaggcaggcgaatgatgtgaagtgtaagcacggtattaggtattaacagtcatccagagatgatctaaaatataaaggaggatgtgcataagttatatgctaatactaggccattttatatcagagacgtgaattctgagggtgggtgcaggtcctaaaaccaatccccatggacaccaagggatgacagtattccatactgaatgattaatctaggagggcaactgcttcatcttactgacagaaaacttaggcctggaggggttaaaggggttaaaagatttctccaagagaagtagtggcgaactggaccgggatccagtcccaggattcacccagtgctctttccacaactctgtgatgtctctctacttccacattcccgttcttcatccccattcatcacacatccttctcaataattcttcacctctctgtttttgatggcttttacagaagcccagtgaaattagaagctattttgagatgctaacaattcaaagatgcaaagaaaagactaagtcttgggaaattttcccagttaacaaaataccacttgttctccaaggaagttgttctacataggctgtaagaaagcagtctgtttgctatttaagattaagaggatgaaaataaaagcatccttactcaaaggaaaaatgtcagttcggaagattctgctactgtgctgatctggttcttcaatgaaaggtgaactaggaacttgtctcagcagcactgttatttgttgttcagagtgaaaagccagtgaactcttgggacactgccagagaggcctgggaaaaaaagaaagtgctcagatttgtgaatagctgtttgtatcttactgggaatgccccgacctgaactgcatagataacattagcacgactgccagggaggaaaatctttactgtagagaaaggggcattggcttaaagggactttcaaaggagatatttgtgagtacctttcaagacaggaaaaaagagaaactcacatgtgggctcctctaaaactgtcacaaggagagactacttgaattgcagagtgaaattttaatcacaaagaccacagccctacctactgttcaaatactcaaccgcccaccagaacttttccattccaaacgaccaggaggtttaactcttctaaatagtcactgcttaaggatgaagaagaaacgctgaacattagagctggatgaaaccttactcaatatctacctgctggactctgggctcttcgaggacaagcaacatgatatcatttttaaaaattcctttggcatacacagagaagaaacagttgtcttttgaataaagaaatgaatgactcaatctgtgcatttcaaacgctagcggcccaaacatttgcttatagtagggcagagccaaaactagtaagccaggttttccaactcccagtttagggatcttttatagcactgggggtttttctatccacacaaaaaattaatcaacaaagctgcaatatggtgatagttgaactctgaatatagtaaaaatcattgaattgtactctttaaatggttgagctgtgtggtatgcgaattttatctcaataaagctgttattaaaaaataggccagacaagggggctcatgcctgtaatcctagcactttgagaggttgaggcaggtggatcccttcagcccaggagttcaagaccagtctgggcaacatggcaaaaccccatcttcacaaaaaaatacaaaaattagctgggcatggtggcacgtgcctatagttccggctactcaggaggctgagatgggaggattggttgagcccgggaggtcgagtaaattgtgttcatgccactccacttcagcctgggtgacaaagcaacactctgtctcaaaaataaaattaaaataaaataaagctacattactaaaaggcaaaatatattgcaatgaatacattaaatcaaaatcctcttaacaaggtggcaaaaaaaccactgcatgtcaatataaatgtcttaaaaactcaagcacaattatttatacactaaaaacaatgtaaaatacaaaaatccaaaattatgttaactaaggaaataactattaattattactttagaggtttcttggcttaaaaaaagtttggtcacaatgctatattaaacactttaaattccatgattttttacttgggaaaatattagtaaactcagaaacttaaggttgtactggaaataaaaatagggtattccatcaattatgagataagttaatggtaaagtatgataaaaatttaatttacactcaacttttcccagaaagtccatctttttaagcaagatactcaaatatatatatttggagacatggtcttgctctgtcatccagcttggagtgcagtggcatgatcttgactcactgcaacctccacctcctgggttcaagtgattctcctgcctcagcctccctagtagctgggattacaggtgcgcaccacctcgcctggctaatttttgcattttttagtagagacggggtttcaccatgttggccaggctggtctcgaactcctgacctcaggtgatccccctacctcagcctcccaaagtgctaggattataggcatgagccaccgcactcggcctatatcccttttaaagacttgaattactagtgattgaggaattctatttcaatttgcaagatgcaagacaattctggggctttagacaatgtaatttaatgtgattccttttaaaacacaaagataaagaattcatactcatattctcataattctttcttaagatatttacccaactttcttgtccaagatactaccaccctcttttcattagatttgttcaagtctgattaatatttgctgccacctagaggcacagatagtttgtttaaaaatcatcattctggttaacagtgatttccacatgttgaaaattgggagcaaggtagaagagagagttaatttgcccatttatcattctcaattaaaaaaaaaatatgttcatcactttcaaatgactttatgataccctaattttcttgtgctagaagcattaaaagccttagaaaataatcattgctatcagtaacattttcttctccaagtcagctgagaaatgcagagttttgcatgaaatgagcatgggtgctactacttgtcttgaattgctgtttttgttttataaggatataacagttagataaaacctgagctcatttccagtgcttacattctgagatttcatggcatttcagctttctaaagccttttttaaaattttgaaacattctaagcataaagtataatacaaagaacaatacaacattttaacattcaatttcatttctatctcaaaataactgagataagcaaaggcacagagagaaggcaaagaccattttctgagtgtctactaagtaccaggcatttcagaaccctctgaggtcagcgccatcagactcatctacagatgaaaacaccccgaggcttagggagactgtcagtggtgcagggtcacaacattaggaagcatcagagctgggattctaaccctacatctgttagattctgaaacactgagttcttcccagcagtactactctgcttccaatattccttttcctttttttttttttttttgagactgggtctcgctgcgtcacctaggctggagtgcggagtgcaatggcacgatcttggctcacctctgcctcccaagttccagcgattctcctgcctcagcctcccgagtagctgggattacaggtgcatgccgcaacgcccagttaattattgtatttttagtagagatggggttttgccatgttgtccaggctgttctcgaactcttggcctcaagtgatctgtctgcctcagcctcccaaagtgctgggattacaggcatgagtcactgcacccagccctgcttccaattttcaatacctttgtggacctttattctacagataactgaagttcagaaagataaaacaagatgcctaagtttatgtaacagctaataggtggcaggactgaatatgactcaaggcttctaatttcatgtccactattcttcccatcaagctatatattatgtttttgtttgtttgttttgagacagagtctcgctttgtcacccaggctggagtgcagtagcgcaatctcggctcactgcaacctccactttctgggttcaagtggttctcctgcctcagcctcccgaatggctgggattactggcgtgtgccaccacgcctggctaatttttgtatgttcagaagatctggggtttcactatgatggccaggctggtctcgaactcctgacctcaagtgatccacccgcctcagcctcccaaagtgctgagattacaggcgtgagccacagtgcctggcccatcttttgtatatttaaaacaaacaaacaaaacaaaaaacaaaacaaaaaacccttggaaataaaatatttacaaatttccaactgctcagttatgagctttactagtcatccaacttagaaatgagaaatgtatctgtatagacatgaaatttcagtaagcctatcatttctggactttaaaaaatgtttttaattaaagtaaaagttacagtgaagtgcacacatcttaagggtacagtttgataaatttgtccatgtgtatacctgtgtaacccctgcccggatcgagtatttctggacattttaaggagctacactatgaaattgtaagcccaggtgcaaagcaggagaatccagacagcccatgcacatcaataaagagatgtttatgacacaaaccagtgagctaaggctatggaaatctgtcatttttcccatagatagctacagaagcagcacatcactgttgggggagacactcgagaacaatctatcggcctcttgtggagcctgggaccctctcacgcacagtgaaaatcttccttatagtaggaagtgtgagattagcaactgtaaatatttaacacagtcctcaaactatggaaagaccctttctcagagcacagactgattatctggaaaaaaaaaaagaagaaagaaaagtgacattgcaaatacttgttaaaagtttaagttctctcccactttttttttttcctgttttgtgtttgtttcctgtttctactaaagcccagggagaagccgactccccacagcctcctctagctgtgtcccaaaagagctaagacaatagagaaagcatcaccactggcctgagaaagagaataaaagggatgggaacaccagtcccttggaatgactacttggtgcattcatttattcaatggttactgaaggatcccacgactcaggcactgcccttgggacgcatcagtggacaaacggtgcctccatgatacatgtcctagcagacaaggtgactgggtggtgctaagggaggctccactgaggcaccaggcacctcctctgccacccttcccccaaatgggtcaacttggagcccgatccagtcattggagaatcttgagggggagggcagcaggagggagagtggactgtgacccggcttctactcccagcacttctgacaccaaatgtgggtgtcacaccaaccaattctccagccctccagacaccaactgagtgtcctacaactgaattcgattctgaccctagctacctggagtcagagtcagatcccacaggttatgggctcagttccacaagcctcccccacttcagacaccaatcacaagtccaggctgcctgtactctgatcgttcacttgaaagggatgggggctacttcccctctcctctggtttcataatttgctagaatggctcacagagctcaggaaggcagttttttgttgctgttgtttttaagacggagtctcactctgtcgcccaggctggggtgcggtggtgtgatctcggctcattgcaatttccatctcccagattcacgcgattctcctgcctcagcctcccccagtagctgggattgcaggcatgtgccaccacgcccaggtaccttttttgtatttttagtagagacggggtttcaccactttggctaggctggtcttgaactcctgacctcaaatgatccgcccaccttggcctaccaaagtcctgggattacaggtgtgagccaccacacccagccgggaaggcacttttcttgcatgtacttggttattatgaaggacacaactgaggaaccgccaaatggaagaaatgcttggcaagatatggggtagcagaagggtgtggagcgccacgacttctccgggcatgtcaccctcccagcaccttgatgtgcttaccaacccagaagttctcagaacccccttttttttatggaggttccactgcctatgcacaactgattaaatcattggccgttggtgattggcccaatctccagcccttttcccctctgtgaaggtgggagtggggggcctgaaaggtccagcctcttatcacacggctggctccctggcaaccagccctatcctgaatctatctaggggcccatcaagagtcactttattagtataaactcaggtacgactgaaaggaacttgttatgaataataaaagaccctctcatccctaacactcagatattccaaagattttaggacctctgaaccaggagcccaaggaaaaaaaccaaatacatatttcttcttatatcacaatagaatatgtggatattatttggcaataaattttatagggaataggaagagtcagaaactcatttctatttccagagttccatctcattgcaatcacaatgatcaaagtaaggttaggctcagagaggaaaggcatccttaactgtgcagcctataaaacactcaccggtttttggagtcgtccagcaatgtataagttattccagttgaggagatcttcaatcagaacgttagtgctaataactccatatttgataagctgaaggaaaaaagaaatggcacaaaacggagtaaaataccatgttattgcttatacaagtataaaatataaggaaacagataaaattcttgaccagagcagtaccttgattccaaagccactcaaaacacctgacttgtgaaaacacacatctccaccaaaacttttgagaggttaagtgtccaagactgatttagcccctagggtatgtaaggggaggttgcaactgtcttcacaagattataacagagaagtctagcatggctgactccatcttgctgccagcctcacaggctggctatccaagctcatgcctgggcgtaggtcaagccaaccaaggaggaggaatatagtttatagtttaattttaaagcaaggatgataatagtccctccctaaaactgttcccctccccagtccagagctgaaatcccctttgtaaaactaatgaaagtccacaagattagggttatgggaagggcctgaattctgctaaaatgttgggatagtttctatgatgtcttactgctcaggagacatgtgtccagaggtcacaagacttgtgagttctccaattaatcctatagataacatcactactgtagaacctaaggttggtcttttgagatgttttcagacttttgcattccagcaactgactgaccccacccagaaccatgactcaacactcaattggtcctgttgcccctccctcagcaaaaggcccactcagcccatgaggactgttttccacacctgtatgattgcatccccaaccaatcagcagcacccattccctagtcccctgttcaccaaactatccttcaaaaaccctaactgccgagctttcagggagagtgatttgagtgacaacaccagttctcctgtgtgcccagcctcacgttaatgttaattaaactcattttttttttttttaagatggagtctcactctgtcacccaggctggagtgcactggcgcaatctcagctcaccacaacctccgcctcctgggttcaagccattcttgcacctcagcctcctgagtagctgggattacaggcacgcggtaccacatctggctaattttttgctatttttagtacagacaggatttcatcctgttggccaggctggtctcaaactcctgacctcaggtgatccactcgcctcggcctccaaaagtgttgggattacaggtgtgagctaccatgcccggcctgattaaactctttacagcaataccacagtcacagtgaaccgattttgtccatgcgacaggcaggaagaacccaccaggcaattacaaggtgaccactatttcaacttaggtccatgtgatgttaaaggtggaatggctcttagatgctatctagtattggtcctcagtggattgggagtaaaaaaaacttgtccttccccaaagacagtttgagaagtgataatttagttcatgttcctcatttgagaaataaaaaacctaaagctcagagacaacaaatgacatgctcaaggtggcaccagtagtagcagagtcaaaactaggtcccagaatttcagtctggtcttccaatgctcttttcattacaaagtacaagaaattttcctttaattagaagttttcactgacatgctttacatagtgaatttctcttttgctactgactatttcaaacacttttgtaattacaaagcaatatccaaaaataaaacttctttattcatgctaaaaaaagaaattatagttcagcccatttctatttttttttttttttttttttttttttgagacagagtcttactctgttgcccatgctggagtgcagtggcatgattttggctcactacagccctaactccctgggctccagtgatcctcccacctcagtctccagagtagctggaaccacaggcatgcaccatcacacctgactaatttttgtattttttgtagagacagggtttcaccatgttgcccaggctggtcttgaactcctgggctcaagcaatccatccaccttggcctcccaaagtgctaggattacaggcatgagctgccgtgcccggacagttaagcctatttcaataataatttgtataaatcctgtagatttcccaggttacaaagtcccatttgcataaacaagtatcttcagacccactttgctgaacctcagtatccaaacagccttctcaggctgcaaatatataaaaagcagttaaaaattatcaattaaaaagtagtcttttggcatataattatgcccaaacatttggttactggaacttataatattctttgaaaattactaattacaggtaggtttggcataatattaactgtggagaaagaacaaagctaagtgtcctgcatgactcaagtggatgcagaaggctgtgctgagtgtcagccttttccccccaactccagcagcagcactgcagaaagcccttctagctgcaggcaagtaaccactgggaggtaacagaaacaccacgggcctggaagtcaggggacctgttgcaaactagctgcacaaccttatggaagtcatttcctctctctgaacttcagtttcctcaactgcaaaatacaggtgaagcaaggttggatctcaaccggaaaagcaaatatatggcccaaggggtatgcagacgtcaccagtcaatcacaacactcactccttagccaagttcagacagaccttcaaatccttctcaagtcagtactccaacctcctgccctttaaagcgtgggcctttgaccaatggcattggcatcacttgggagcttataacaaatgcagaattacgcctgtaatcctagcactttgggaggccgagacgggtggatcacctgaggtcaggagttcgtgaccagcctggccaacatggtgaaaccccactctactaaaaacacaaaaaattagctggacatgattacagtagtgggctctgtaatcccagctactcgggaggctgaggcaggagaatcgcttgaacctgggaggcggaggttgcagtgagcagagatcgcaccattgcactccagcctgggcaacaagaacaaaactccatctcaaaaaaaaaaaaaaaaaaagcagaaccttggtggggcatggtggctcacacctgtaaatcccagtactttgggaggactgtttggggtcaggagttcaagaccagcctgggcaacatggcaaaaccctgtctctacaaaaaatacaacaattagccaggcgtggtggtatgtgcctgtagccccagctacttgggaggctgagacaggtagatggcttgagcccgggaggcagagattgcaatgagcggagatggtgccactgcattctagcctgggtgacagagccagaccctgtttcaaaaaaagaaaaagaaaaaaaaaaggcagaatctcaggttccatctcagaccaactgagtcaggatctgcactgaaatgggatctccaggtggctcgatgccggccaaagcctgaccgccttgaacaatgagtggcagagctggcacagcaagtgaaacccatatgtcatccctggcccagggaagctctaggaagcatctgatttagacccctactgatccttgcaggctggggttctgcctaggtcttgacagctctcttggagactgcgatgcttcagctgaaagacagttcagcaaagttcctgctgtcagatgaaccaccagcaggaatccatgcaacttacctgctctccaacagcccactgtcaaattccacgcgtctcctggcaccaagaggttcccgtctatcacctgacacacatgctctcaatcacctgtgatatcctcttcacttccaacttcttcctgggggtgtctgcccctccttctagataaaatcaatctccaacctgacccaaaattggcctgcctattcctcccactgaccagaccaatggttctagaccagcagcttcagcactgtttggaagtgtgttaagagatgcaaatcttcaatccctaccccagacctagtgatcagaactctgggggtggggcccagcaatctgtgtgtccaatggacacacaacctaggggattctgatgcacactaaaacttgagaaccacttggccaaagacaaaaaaataaagtcagtgtggccgggctcagtggctcacgcctgtaatcccagcactttgggaggctgaggcgggcagatcacctgaggtcaggagttcgagaccagcctggccaacatggtgaaaccctgtctctcctacaaggtggcacacgcctgtaatcccagctaactgggaggctgaggcgggagaatcacttgaacccgtgaggcggaggttgcagtgagctgcgatcacaccactgcactccagcctgggcaacaagagcaaaactccgtctcaaaaaaataaaaaaaataaaataagtcagtcacacccaaccacctcctcacactgcaatgacagttaatgggacatgaggaaggactccagtccctgctctgtccccaagttcaagacgtctggcaggagtgtgaatgtttcctgactataagaatatacatactataaaaacatacatatttcccgactataacaacgtccagcaggagtgtgaatgtttcctgaccacaagaacatacatatttagctggcactctaataacccaggtaaataaccagccaagttaagacaaaggccagcagtcacttaccctaccattacacatgatcaatgaattgtagtaaactccagcgccatagttattctggatggacgtgataatcttgggccctaaaacttttaggaaagagtagtgactccaatttttcttcaggttctttgaatgccatgcgacagggtcatctactgtgaacacaaagtccagcatagcattctgtggagtgaagaaaagagaataatttcagtattaattcctagaaaggcagcaagagagcatggaaaagctctaacatactacgcaattatgatcaatagtcagaaggcctggtgctgtcatcagaaatgtgagcgagtctctggaacaaatatgagctttgttttcatcaatgtaataatagcaaacacttctttaacatgtattgttgtgccagcactctttaaacactttatgggtaacatacgcagtcactccatttatcctcagcacaaccctacaaggtagctactgctattatctcaattttataagaaaccaaggcacaggggatgctctttgcccaaggacacagagcttgtgagtggcagacctaagaggtctggctccaaactgtgtgtgctgaaccactgcactacactgcctttcacaaatgtagctaaatgtgctccgcttttcttctggatcaaattagcaccacctggataaactctacaaaatactatataaaaggaagtcagttattttatctcttacctattcaccaaccacttattgagtacataagtaatgaactctgacaggccctagggtagaagtatagagctcagagtctactggagagaataaacaaattatcactacattgacttgatagaggaatgcaaaatgtactaactgcactcagcatagggatcagatcaggggcacaggagggagaaattctcctagagatgacaaatctgagtcttgaaggacacgtgagttaaacagacttgctggaagcactgggggaagcacagggaagggtagggagccgtgttggaggaaagtgctctgtggatatgggagccagcatgttctggaagctgccgtcagatatgactgaaatagaacacatttatgcggtgggagatgagatcagagagggaggctgtttgccatgctagaaaattttcctgcagaagagctgactggagagaagagggactaagggggtgggggaattagatctgaagccatggcaagattccaggggagaaatgaaattatattagctaaggcgctaaggatggggactgatgtgagaaagatgtaggtgttggaatctacaacttgttcacttgaatgtaaggaatcaaaagtgagggaatgggaaggaaggaccttttcttgcagggaattccaggtctattcaaaggaaaacctccatggaagaatgaagaggtggccatcaggaggctaacgcctgctctgtagagtgtgactctacagaccactggggacacttgagatttggtggcgaggcaggtatggaataaacatgttttttaaaaatgtgtaattatgttaaggtaaattcgggaaaaataactagcctataataacctataatttctcatatgctgccaatttaaagaaaaatattaaatagtagtgtaagtgggaaacagaggaaatccaagcaacagcatagatggcctcaccaggaagtgaacaggcaggatgttaatcagaagacagactacagtcaggtatccagacgcagggggccccattaaaacctgcacactgaattctgcaaattacaaggaaaactgtacccttactgaggctgtgctgagccaactctgaaaagtaacaatgcctagtctcaaacagaccgttgttaaaagtgctgagcgagggtaaatacactggtcacgcactaacttttgatgttagttactttcactgcacctgccctggccctacaaccagtccgccaacttcctgaagtcagaagatcattttgcattttctcctacatttatagaggtgactctcaacaaacttggctgcgcattagaatcacctgggacgtttcttaaattcctgaagcccaggcctcatcccaaaccaattaaatcagaatctccatcggcggaagccgagcattaggattttcttaaaagctccccagaaaattccgatgtccagccgactaaaacactgaaagaacctgataacgatttcttttcctttcttccatttgcccctgcagcagtttttccttctgcctaactgcttctcctgctctagacccacgtggattcctaagtatccttcaacaccgtcgcttcaactcgcgctgtcgttatactaggaaggcaggcctatggttcactctgctagtggacacgtggagtgtgcagagcggacaggcagctctccgactctgaaggaatcgagggcaaaacgggactcgtgagaacagacagttccccgtcgtggggctgcccgggctcaccttctggtctgaactcggccctgcctggcggtacaccccggagccgtagacgaaagccagactcagctcctcggggaagtgagacaggatcttgcggaaggtcacccacgagctctgcagcgtctgcagcgccatggggtcgaggctaacaggggacactcagcgcagcagggcgaggacaaccgggcggggaacagacaccgggtaggcggtttagggtgggaaatggaagtcggagactggatcgagggacacaaggctgagtgtggggtgggactgcaagcacacgcaaggattggggcgttgggccacgaagagcagcggcgagaagacgcagcccagataggctcgggtgggcggcggtcgcacaggcagagcttccgtcccttgctacgccccacgcacgcacaggcgcttccaagacgcaagaggcggtgctcgccttagtgtggggaacgcgaggctttgcattgtcccctcgtggtcggaggagtgccctacaggctggcggctaggttgcgacttggacaaatcggcggaggcgagcgtcacccgactccgcgggccctgagccttgatagcctctgtacttctctcttcaaactacggtttaaagaatgactataaaatcgggagcgtattgaaggtttttaagtgaggcgacactcacataatatggaactagccgttctgaaatggacagtgtagtagcatgtagtgccttcacaatattgtgcccccatcatcgctctagttccaaaattgcagatttcgaagatttggaaaaacacaaaattaaaatgatgcccaatcccgccatgtagagaataccaccgtcaagatttgacggagacttcttcacgctaaagcccttttcaaatacaagggtggatatgggagtgcacagacgttctctgatacttgcatttaatttcaagggtggatcacagtttttgcccccttgccttgtggaatggtctcacaaagggtgcttcaaatgcagtttctggaggaaacaggaccctaggagtagaaaaatcttacagctctcctctttgtataactggagaaacttgctgaagattaccattcaggaggtggtttgacttccaggacagaaactttttcaactaccctctccttcctccccaaaatacactacctctcaaaaataatagaaatagtaatagctaacattcaggtaatgttgacacattttcacatgcacttctcactgagcaccctctagtgccctgtggcaggagggccttggttttactgatggccaagctaaggcttagagaggtaaagccaggtgataggatcacatcagcctgtggcaaaactagagctaaacccaggtctggctccaactctgggattttttcggaaattctgctctgtccttgaagggttttgagcaaggacttatgtaattcacatgttagcctgaattgtgggggactgattagacagttgttatcatagttcccccatgaactggaaacggctaggccaaggtcttaggagcagggatgggattaaatcaattggaaaaatgattacttgcactcacactctgggcctgcactgagatgaagagatctgagctgcctgctgccctgcaggagctaggggtctgtagaggagaggagacagaactgcaaatcagagtagaatttgggtaatgcagccaggtacccagcacagtgccggaatgtaatgtccctccaatgggaacgtcagtcagttctgggtgttggggaaagggaccagaagaggtttcacaatgatggcattttgagccaggcctggaagctgggtaggagtttatcaggtagaagatagatgggaaaattcaaccaagaaagaattgaaaggactcggtgacaataatactaataataggtgtcattattaagcacttagtatgcccaggcactttttagacttctttggggcttttctgtttttgttttttttttgagaccgagtcttgctctgttgcccaggctggagtgcagtggcacgatctcagctcactgtgacctctgcctcctgggttcaagcaagcatgcctggctaattgttgtatttttagtagagatggggtttcactgtgttggccaggctggtctcgaaatcctgacctctagtgatttgcccacctcagcctcccaaagtgctggaattacaggcgtgagccactgcacccaggctttttatacttgtttcttttcatcactccagagatcctatgaggcaggttctctaagatgatgatatttttcatacgaggaaacagaggtcctaagaggagcagtaaatgttccaaagtcacacaggaaagtggtgaagtcggggtttgaacctagggctacctacctctaaaggccaaggtctttaccaccatgtttaagtgtcctctacagcggcttgcagggtgagagaaggaaatgggaagaaagcaggcactcaggcatcagccaagagtcaggagcagcagcagtagccgcagcaacaagcaggagaccagggcaagggagcggagagaggccgtttgtctgcggcccctggtgtgggcatggtcacttccgttcatttttactacatatcgcccttgcccagggtgccggaatcagagtgcactcaccgtggaattacactgaagcctctcacccaaagacagtgaataaatctcattaccagccggttccttttttatttccttccttcccttggggaaataattcaacgtcattggatttttcctgtttgcaaaagtaatccatgttcataaaaatgtaaacattatgaaatacatacatcatgccccagaaatagccacggtaatctttggcacatattccttccaatatttttctatgaatatattaacattaaaaacaattttaagtggattcctaggatagatactattttgcaatttgctttttttgcacttagcgtatcagggacaatgttctgtgtcagaatatatagatttccctcattccatgtattagtagcaaattattctaagatatggatatgccataattttgtttaaaattttttgtttaaaagaaagtgtttaaacattttctttctctttctttctttcttcttttcttttgtttctttctttttttttttttttttttgagagcgagtcttgctctgtcacccaggctggagtgcagtggcacaatctaggctccctgcaacctccaccatccgggttgaagtgattctcctgcctcagcctcctgagtagctgggattacaggtgcccgccaccacatctggctaagttttgtatttttcgtagagacaggggtttcactatgttggccaggctggtctcgaactcctgacctcaagtgatccacccgcctcggcctcccaaagtgctggggttacaggcatcctggcctgtttaaacattttattgttgatggatgtaggttatttctagttttcacacctgcaaacaatgctatcatgagcatccttgtacattttatgtgcatgaacaagtattgctataagacagattcctagaaggggaattgctgggtcagagtgtcagcacgctgctaaattcccctccaaaagatggtgccaattcacacacccaccagcagagttcagcccttgatagaaataaagatgctgcaatgtttctccatttgtctcccttacaggcgttcacacccaattatcagcaattttcatgttcacaaacacttttcttcctgcaatgcaaaaccaccagctggaaggttccatcacattcctgtgtgcattttgcctttccccagaaagaggcagaagcaacgtagccacgaacacatttgtattcttcagcagaaatctccctgctcctggcccttcatccacccactctcttttaaattaccatggcttgtgaaattagaggctattaggaagacccagtgttctatataatcgctttagggttctgttggaaagcttataccaatgaaataaacatgttagagagccacttacaaatatagataaatgcctggtgactcgagtgaatattgggcctcattcttctgatttatctagcagttgtctttgtattccttaataatgaccttgtcaggctttcactaggagaaggttcatcgaatccatgtaatccattttttttaaagccctgtaaaaaaacatctatggctttaatgctttttttttttttttctaatcagtgtttaagtacaggagagaaaaatgtttggggaagaataaaaatccaggctcagtggttcttacaattagccacatgttcaattggtctgctgatggaggggaaggagaggggtcttgatctccatcttgtcagaggtgggtcaccctgtcccatttgtccattctcggctgattgatggttagaactgggacagactgggagcattttttcgttttttcttttcttttctttcttttcttttctttttttcttttcttttcttttttttttttttttttttttgagacagggtttcactctgtcacccaggctggagtgcagtggcacgatctcggctcactgtaacctctgcctcccaggctcgagtgatcctcccacctcagcctcctgagtagctgggattacaggcatgtactaccacaccaggctaatttttgtatttttgtagagaatggggtttcaccatgttgtccaggctggtcttgaacccttgagctcgaacaatccacccacctaggcctcccaaagtgctggaattacaggcgtgagccactatgcccagccaactgagagcatcttaatacatctttagtgtctgatcaggggcttgaaggtaccacctgggttggaatccaggccccaggatttaatagctgtgtgaccttggacaagaagacttagcctctctgtgctttcctttcctcatctgcagcctggggagagtaatgacacctcactcacagggttgttgtgacagcaaatgaaacagtatctagaaagtacatagaatagtgcctggagtaagctttcaataaacggaggacatcctcctgaattcttaagagacaatgtacaaaaggaattaagaagcataattatacctacatctttatggcgtttagcattttacacaaagcactttgcagacatgattttatttagctcttaaaacaaatcctgggaaattagtagctactatttcagttttacagatggataaactgaagcttagaaaaaagaattgatgtgcctgaagtcacagggctaatggcagctgctaatacagcctccaagtccaatccctttcctcttgcacgagaaaaataacacggggtgttcatttcaccaagggacccattcattcattgattcattctcccattgaaaccttcctcatcctttagtcccagctcagctatcaaagtgttctgttctctgtgccttcctaaccctttgcttttagctctctagctcttgtcttaaatatcagatatgtccatcaagtacaattataaaaggcttaggggccctttgaggtcaggaaccatatcttattaatctttctgtcctttagtgcctagtacagtgcctgaaacaaaatttctgcatttgcaaatgttatagtctggtggcaaaaaattcacatgcatgcaaaaaaaaatacactatggagagtataaaccagatctataccaccgcaatggtaagacagcaggggttactttttcttcagggtttctgggaaagcttcttagagggatgacatttggattagaccttggaagatgaccagcagttcaccagagagtacaccgtgaaaaaattctaagaagaaagaattgcctccatactgggtcttagaatcctccttctagggggacactgagttttccagtggagttcaggaagaccatggacttttacagtaccaaagaaatgaataaataatggtggaattccaaagaacagagcaggtatctcatctgagaggcagaatgtggaatctggattgagactgcttggtttcaattctcagccactgatgatctgtgtgacctggtgcaagttggctctgtgtctcagtttccacaagtataaaatggggataataagagcgtctacctcccagagttgtcatgacaactaagctggttagatcaatctctgacatgtagtgagtactacgtatgtgtttacccttctgattctccactatccctgaaattcaagctggtcagcagctgcccactttatctctctgtagaactggccctgaattttgggagaaactgaattggcaaagaactgagttagaagagaaagaattagttaccatataccaagtctgtctctggcatgaacccctgcgatctgggtttggtgtaaagcagcttgtcccaaggagggttatttgataaaaaattctatcagctaagtttgggaaattctggattaaacagaggcaaatcgagatctttgatgtgggattcctccgagcattaatatattaataagcattgtgaatctccaagagagaagcagaacatgtagcattttccaatctcccagactaggttttcctccatcctctgctccctccaccttctctctcagtgtcttctgggattcatattctgtggcataaatttaggaagcgctggtgccaagcactcccttgctgtcccagaatcatctcagtgtcccaaaccaatcaagactaattttcacggacctcttttgcctgaaggcaccaggggatcctatagcctaagagagagattggggaatttctcaacacatgaattacggtt

SEQ ID NO: 1799 - DNA, 3040 bp, Homo sapiens
tgctttaaattcgataattcaggaacacacttaaaacataaagcaagcatttctgtcctctatatgtttcttaaatgatctctagaaaaatcatgtaagtccaaactaagttattattactttttggaacagaatgtatagcgtgtagactgaaactagattataggatatgatttctttagtttacactcaaactttgtgctccttttaaaaacatttttatcttcttcaaatgaaaacacagacatctttgccaagtccctatttttaaaagttggggtaaaatatgcataacataaaattgactgttttaatcattttaacgtgtattattcagtagcaataagtacattaacattgttatgcaaccatcttcattatctatctccaaaacgttgtcattccaaacagaaactctgcactcattaaaaaaaggatagttctcacctcattcccacctcctctggcctctggtaacctctattctactttttgtctgtatgaatttgtctattcttggtacctcatataagtggaatcacacactatttgtccttttgtgtctggcttatttcacttagcataatattttcaaggttcatccatgttgtaacatataacagaatttcattcctttcgaagcccgaataacattctattgtatgtatataccacattttgtttatctattcatctgtttatcaacatttcggttgtttatccattttggctattgtaataatgcttcccataaacattgatatacatatatttatttgaatccctgttttcaatttttttgggtatatacctagatgtaggagaagtgctggatgatatggtaattctacattcagctttatatatatatatataaagctatatatgcatatacatagttatatacgtgtacatagatacacacacacacaactttttaaaaagttatttacttttttaagtaaccaccaaactattcagtgcaacggttgtaccattttgtatccccaccagctatgcataaggctttcaattttccacatctttgagaacacttgttattttccttttatttttaaaatagccatcctaatgggtgtaaagttctggggtgttttccaaaactaacaaccagttctccaattcttcagacaccaatttggatgtccaacaattcaagtcaattctgacactgcctgaaattgcatcacattccacagataaatgggttcagtacccacttcagatgccaattgcaagtcccaggccatcggtaattctgaccaaccaactacaaatggtaggttcccatgacgcccctcctcatgttcaacagtttgctagaatggcttacagaactcagggaaacactttacttatgtttactagtttattataacttaggaacagcccgctggaagagatgcacagggcagagcatggggagtgtagtgcagaacttccatgccctactgggcgttatcaccttcccagcaagttaatgtgttcaccaaacagaaaactctctaaatctcactgttcaagagtttttacagagctccatctccagggcctgccctcccctcttcccaggggtcagtaggtgggactgaaagtctcaaccctctaattacttggtctttctggggaccagctccatcctgaggctctttaggggccccactctaaaaaaccttatgaacataaactcaggtgtgattgaaaagggttcattataaataacaaaagacactcctttcacttagaaaattccaagagtcttaggagccctgtgccaggaaccagagataaagaccaatatatttttgcattataccacaaaattggtacctcctggtggttttgatttgcatttacccaacgactattgatttggggcattttctctttttttttttttttttgagacagggtctcactctgtcacccaggctagaatgcagtggtgtgatcatggctcaccataacttcaacttcttgggctcaagcgatgctcctgcttcagcctcctaaatagccaggactacacatgtgtgccaccatgcctggctaatttttagaaaatttttgtagagatcgtgtctcactacgtttcccaggctagtcttgaactcctggactcaagcaatcctcccacgtcagcctcccaaagtgttgggattacaggcatgaaccactgtgcccagccagcatctttttattcattggccatttctatatctttggagaaatgtttattcaagtcctttgcccattctttaaaccgggttgccagttcttctattgttgagtcactggagttctttatatattctggatattaatcccttatcagatatatgatttgcaaatattttatcatattccttgggctgcttcttcattttcttgatgtgttctttgatgcacagagaatttttaatattgagagagtccaatttgtctatttttttctcttgttgactgtgctttcgttgtcattccaagaaatcattgccaaatccagtgtcatgaaggattttctgtgttcttctaagagttttatagttttagctcttttgtttagatatttgctcccattttgagttactttttgtatgtaatataaggtaagggttcaccatcattcttttgcatgtggatatccagttttcccagaaccatttgttgaaaagactgtcctttctccattgaatggcattggcgcacttgttgaaagtcatttgatgatatatgtaagagtttatttttgtcatggaaataggtcctataatccttttgcaggtatataaaagatacttcttaacaatataaatatacataacacagaaaggctatgccagaggggctatcataaataataaaagcatattgtaacaaaagaagaaaaacaaataccacccaaaattatttaaagcacatttttattatagataggttaagtgtggtttgctgtggctaaagatatatttataatggatgaacaagcttttctagataccaagaggtataatatttt

SEQ ID NO: 1800 - DNA, 5204 bp, Homo sapiens
ctggcttgctcaaattatgttcacatttctaaaaagaaaacaaatataacacgtatcagaagacaacaacacactttgttgatccatagagctgctaaattcagaaggacagcatttacgagaattttgttttgttttgttctgctataagaccatatgtttttgaataatgtatagcagccaaagtttataaaagatgttcgcacttcctgatatgtgcaaccccactatccaatattattatacctctgtggtacttaaaaactactaaaataacacatactgagtacatactgtatttgctaaacaacgtgctcactggtttaactggatttaaatatcacatcaactttatgagctaggtataggtattacattaaggttgccatattatagatgatcaaaatggtatacaggaagggtaagtaacctgtccaacttcacagagccaataaaaatggacactgggatttaaatctaggtagtaaaattccagatcctatgctttaaagtacagtaacaatgattacttttgagatagggtatcactctgttacccaggctggagtgcagtggcacaatcaaagctcactacagcctccaactcctgggctcaagtaatcttcctgccttggcctcccaaagtgctgggattacaggcatgagccactgcactaggacagtaataattatttactactttcttaaatacatactacatatacctggttaaaaatttttttaacagaacaaaaaaggtgtccagtgtaaagattacccattatctgtctgtccccttgttttctccagatagcctatgcacataaaagtacaagcatacatcaccttgcttttttcacaataacacaaaagggaacattttatatttattctcttgcttttttcatttattctatcttggaattaattccatttcagtacatatagagaggcctctgtgtcccactgtaacaatttctataacttacataagatagaaattgatggacattcaggatgtttccattattttgctactgtaagtaatgcagcgatgagtgttcttgtacatgaatcatttcctaagtgtctaagtatctgtaagacaatttcctaagagtagatcaaagggtgtatgcatttgctattttaatggatactgaaatataactgactaatctgacgattatgaaatgatattccactgcagttaattttttttaatttttcattttctcattgcagttttaatgtacatttccctgattagtgtataaatttgaatatctttcatatttattggctattgggatttcctctgccataacttgaatgttaggatctactggttatttttatttccttgccgatttgctgatattaacaatagattttaatctcttgttaataatataccttgcaaactacttttctcagtctgtggcttatcttttcatttctttatgggttttctttggcatgagggtacaagttttacttttaatgaagtaaaatatgtaactttacattacagtttgtgcttatttgtattacttatgaaacatttccctacccagaagtcatgaaggtattctcctctatttccttctagaagtttggctcttcagatttccaatgttcctgaaattaacttctatgtagggtgaggtagcaacccaattttattttcttccatataatcacttgacctagcaaaatataattgcctattctttccccaatgatctacaatgccatatttagtatataacaaattttctcatatgcatgggtctacgtctgcatacatatagacacacttttttttgtttatatgtacatttgtactttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaagcatcatttttacatgaaaagttgtctgtcatttgaaattatgcaaatgatgtcttgacctgaagcacaaaccccaggtacttaatgtttttaataatatggtgccactgcaggggttaggggcggtggggaagaacaaggataatggcggggaggattggcctaactaaccactaagtgaattgtactgcagctttgatttatgagacatccttatctgggatatttgagggcagctgcaaactaaaaacaatccagtaaatgtactttgtttatattttgtatcaggcaattatcaactgctaaataatagctttcatatttgcaactgttgcatacagagtacttttgctaaaaggtgattagctcttgcctttaattttacagtgcttaatgtgataaacttccagacatgtttcctataaaagagaccatttaatatatgtatataaaccacagtaatagtataacatactattttaaaattatttttttctacttaaaatatttaattttaggcttcttaggacatttctaaagcagattaaacccaataagcaggccgggcgcggtggctcacgcctgtaatcccagcattttgggaggccgaggcgggcggatcacgaggtcagaagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaacaaaaaacccaataagcttcctgatgatttttttgtaattggagatagttttctcaactgaaataacatttcagctaaataaagcattttaaaatattgatatttgataaaaaattgccttgtataatttctgtaaattatatttgttctgaaaaaggtataatgccctaatgttaaaagattttaaacaaatccttatcctttgatttttaaaactctgatctaatgataaaattctataaattttcattttcccgtgcagttaggtagcaaaatagctggtaattcataacttttacctattaaaatataaacacacaacaagcaaatgtatttaagagtactaaatggaaataaag

SEQ ID NO: 1801 - DNA, 2134 bp, Homo sapiens
ttccctccttttttatacagaaaaagtgcatacctaccatgcactttgctttttgcatttaaaaatgtatcccaggctgggcgcagtggctcacgcctgtaatcccagcactttgggaggctgaggcgggcggaccacgaggtcaggagattgagaccatcctggctaacacggtgaaaccccatctctactaaaagtacaaaaaaattagccaggcgtagtggcgggcgcctgtagtcccagctacacgggaggctgaggcaggagaatggcgtgaacctgggaggtggagcttgcagtgagccgagatcacgccgctgcactccagcatgagcaacagagtgagactccgtctcaaaaaaaaaaaaaaaaaaaaaaagtatcccatattaacacattcttttataaatttatagtactcattctgcggatatactataatctctgcatattttggtttgtatttgtggaggtgcaaggtagattcctaaaagtgaagttgatgagacaaaaggtaactttacttttggtaggtattactatattaatggtgcattatataaccatatttatataaatttatatcaatttaatttatatataactatttccattactaatcttttttaagaaatcaacttctgattctgttgcccttttgtattttggtttcttaatttactgtattttatattaatttattgtattttattttggtttcttaatttattaacacctgttctctttggactttgctgttttttttctaacttcttgaaatggatgctgacatcgctaatcttttaatatttcttcttttctaatatatactgtatagctaagcacagccttagttgtatcctgcaagttttgctataaagaaattactgattcctaacttaactacgttgtgatcaaataatatactttaataatttcatcttccagctgacagcctcagcaagagaaagcatagggactccaatggcagcagcagcatgtgcaaagaaacaatcatgaaagttggtagacaatattggatgggtgccccaggtctctccaagctggctatttattatattttgttatttaaaacaaacctgtatttatttattttttgagacaagttttgctcttgttgcccaggccggagtacaatggcgcaatcttggctcactgcaacctccgcctcctgggtacaaccaattctcctgcctcagcctcccaacaaacctatattttaagcagaattaaaaaaaaaataagctggtataaggctatatgacttttgatcaaaccaacgagatgcagggcttctaaatataagggatcatctgaaatgaatgttgtttgaaataactgtctaattttgagagttccagtatttatgtgaaaatttaacaatttttaaagaagtccttggaaattggtattgacagtaaatctccttaaaatagaattttaaagctttcaacacactggaactctccccagctttggaccaaccccacaactgagcggagccacctcctcgagacatgcattgctctgctgctggatactctaacagcttgaacaggggagctcacttaagaagagatattgtgtagtttaaaacatattagtttgtataaaataacttctcataaatttctcataaattaaagctgcagtacaattcacttagtggttaggccaatcctccccgccattatccttgctttgttataaatcaccattaaaaaccattataatgtttttaatagtatcagctggcacttaaatatttttggagtgaaaattattcctaaagttatacatgactcccacaaaaatacagttttatcatattaaagagacctgtactgatttgccaaaattccgcaacttagcaaaggtattaccttccttggatttgtactttgtgatacagtgtgctgtaccgtgggctggttatgttaactgaaaaaatagtcattacccaagttttgcagcactctaaacttaagcagaagaacagctgttcacatcttacaaatgccatgtgtcaaaatcatggttttgtaattgctaaggtacggtatgtcaggttatttgaaaacaattactttttgaagtaattgtgaccacaaag

SEQ ID NO: 1802 - DNA, 5688 bp, Homo sapiens
atgccagaatgtaaaatcacaataatgagccatagtctactatgattcttggcctactgtaagctgcaataaatgttttaaatgaataagtgagtttacaagggaagaaaattaatataagttacataaaatttttattaatttaacaattgtaagtcatgatagttaacaggtgaaatgaatgtcttattacttattgaaataaaaattaacaaaagtagttaaaagtgcttgtgttaaacaagcttaaattattctaacacattaattaaatttcaataggcagacattttcaagctggagaagcttgaaaggtagtcagggagaaaggtagtccgtcatttaccaaaggtcacacactctggagggagatttccagcatgcaccggggccattttgtgttgagcttcacagtaaggagcagagatgaagcgtgcagatgctggagtcagactacctgggtttccatttctactttgctatttattagctgtgtagaattagatgaactatttaacctttgtcttcctcagttatttccttcataaaataaggctaaccatataatttttgtgagaattaaatgcatcaacatgggtcaagtgtctccaactggatgtacaggacattctaagaactttttttaggatattaccatagctgtgaccgcttctcgactcaaaacatggaataagggctaaatgcctcttctcctgagaagagtccaaaataatacaaagagtattcatggacgctagttggttttatttctttgatttacttattcttttgttaccaaggctgatgaaaagtgacttttcattaaaaacaccgctaccaaccactactgtcttgcatcacaaccaccaccattgcaactaccatcaccaccattaccacgagttttaccactatttccaccatcacggtagcagctattacccccaccaccatcataaccatcaccacctctgcaatagcatcaccaccatcactatcaccattatcatcactatcaccatcaccatcattaaaaacaacatttttaacatccatgtgaatagaataatgtgaatttagaagtgtcatttggagagtgaaggatcacagaaaagatgtatgtgtacacatactggtgaagggaggaaaaagatttagtgttcaggcagctaaaggaatacaccagaaacaaagatgaagtaatgtttatgtgttatacacaacgtttgagccagtagtttcagagtaaaaccattacaaaggtaaaatgaaaaattccttcttacatgctaatctgtgctgtttgaaatctgtaactaaggttgtttacagtagtggttgagagaatgggctttaattaaagagtcttggattttagttccatatctacttcatacctgcccttgagtatgctatttaacctcccagaacttgtattttctccatctaaaaaatggtggttccattatttagaatttgtgtgaatatttaatacatactcacatataacataagcattcagcacaatgcttgtgcaagattaagaccttcccctgttgccctctaatcagtttctctccaaattttaactactcagtaaatcacactatcattcttaggtaagagttgacttcaattcagccctttctctcctccacctcctgcacccccaggaactcattaataaatttttcctgttctacctctggaatatagcttacattcatccactttgattttacttccctgctgccatctttgcccaagcccagagtactaggatagaccaatctctcagttgctgctcaatacaatcaatcctccacagagcagccaatgtgaacttaaaaaaatgtaaatcagatgatgcttaaagttttcagtagtttcctattgtacttagaatcaaaatttagctctttaccgtcaattttttttctacatgatttgttctctgtctaccttttctacttaaactcttaccattctcccctaattctagaagctttggtcacaccaccctccttagtgtcttttttttgggggggatggaatttcactctgtcacccgggctgaagtgcggtggcacaatctcagctcactgcaacctccgcctcccgggttcaagtgattctcctgcctcagcctcctgagtagctgggactacaggtgcgtgtcaccaagcccagctaagttttttttttattttttttaattttatactaagcttttggctatgtcctttcaaagaggtctcccttatctcaagtagtatttattctccacacctaatccagcttcttatcatcatttcaccttattttttaataactctcacagtctgaagttatatttatcatgtagttgtttatttattcggtcctctattataggaatgtaagtaacttgaaggaaattacactgttggtcttgttcatgtgtctactcccagtgccaaaagcagttcctagcatgtttttgaaatgcaataaaatattcactatgcaaatgaaaactgatttttttttgagaggggcagtgtctgccttaaataatacctcattctggaaaacacaattaattatggtagaaactggagagaaatttttttcttatggagaagaaagccctcaaatccccaaatggaggcatagaaaagctgagaaataagttcacatataagcttaggtctgcatttcttgcaaataatattctaataatgtgctctgaaataaacaaaaaagtttcagataaacttttattaatattttgtttagctccatagtttataattgatctatggtttataattgatctatttaaaagatctatttatacttaggctaacacaaacattcaagagctaaatcattgccaagggtatataatgtctacaacctaaatgtagtggctctgacacacacataacaacaacaacaaaaagactatttgctgataggttgaaaagaaataaagaaaaaaatcagttattgtggttatttagtcaaagaggaaagcaaaactgagattgacatagcatatcaactactctgtactcactgtgcatggggtctgcatccatggctccccatcaatttgcattggcagagacttgctcgtcctgggggaaaatatttcattgtaagtattgcaaggaaatactttatattacagactatatgtgagatataagatgatgagaccagggaaggcaatatggtaatagttgggctctaaatttatctccaatgaaaggagcttcaactctccactattaataaataccctgaaaagtaccttagtcacaggaatattatgagcttcctggtaagtgtagtgacatttaaaaaaattctggatgccaaaagaaaaatttcagggtttatgtttaatgacacgatcagaatttctacagccaaaagagattccttgtttttataaccctacattgcaaactgggagaaaggtgtttctcccagttcttctagcaccaacacttccagataaataacatcaattattcctgtgctacaatccgtggcttcacctgggcagatcacgaggtcagtagtttgaaaccagcctgaccaacatggtgaaaccccatctgtactaaaaatacaaaaattagccaggatgtgttggcgggtgcctgtaatcccagatactcgggaggatgaggcagaagaatccttgaaactggaaggtggggttgcagtgagccaagatcgtgccactgcactccagcctgggcaacaagagtgaaactccgtctcaaaaaaaaaaaaaaaaaaaaaaaaaattggggggaaattttgggcaaaaaaaatgcttgaaaaagttaaaatttaaaacatatataaaatcttactgtggcactttagtccatgaaatgatttaagtcaatggtgtctcatcattgttttcatagataatttgcccagtaaatactttggtgcttcagtagactaatatgagtataaatcataaaatttgtatgtttgaattcgtgcatcaatatgtccatggtagtcaacaagagagaatcagattccaacaaaccatatcagtaatagctaaccaatattttagacaatctgccaatgtccattattttgaaatatattagtattaataactgattatttggagcccaaagaagacaatgttactatcagagttctgcatacttttaattagtttgaggctatgccatatcaaacgcctttgtcagttacagaaagggaactacctgatgaccacgcaggagcactgagccagccgccggccagcacttttcaggcctgtgtatatttgccccatctccatggctccttccaagccgaccacctccagcagctggtcactgagatctgaaagaaagtagatgccttttaagttgcaatgtgtatacatatgtccacaatttaatgccatttgatattatggagattaaaaaaaataacagccacttcacaaagaaagcttgtcttagaaacttaaagtaataaaaagatggcctacttttataactctcagtttaactaaaccttgaggttctgtggaaaatgatttgctgtcagcttattctaaaacaaaatgggaagcacagattctgagccaaataataccaaaaaaaaaaaaaaaaaacccagtagtttttaacatcaacaaacttaatgttattccacatgtatataaggaccatttatacatcccacatcagacatttggcagcaaatacacatttcaacactataaataaaatatgaggatatgctgtcaaacatgattttgttaaattacttgaacaagagaccttggagatcatggagttggagcttctcattttatacattagaagatgggagtccctaaatctttgagtaacttgtctgtagtaataggtaactgtacagaagttcaagaaacaatagtaattttgtgaaatgtttttccgatgttaaggaatattctacaaaatactgtttggtagtatactagataattagtcccatgcaatcattattattaaatttttttttagcagaagacattaaaaaggggctaatagttaagagttgtcgcttgttgagtatttactaggactaattactttatattatctcatttgctcctgctccagaccaatttaagataaatgtgattctcctcatttacagatagagaagctaaacattggagatgttaataattattcatattcacatacctagaaagtgacagagccaaaaagtgaacctaattgctttgatgcactatgctacatttgataaatcaatcatatgaaaaggacagaatttacaacgttttagaaatcatcttaacataaaggtggaggttggactgcgtgagcttcaaggttcctttccaatctgaatatttgcattcagccagaaagcagaagttgaactcacatcaatagaatcccacacagtcctgtcccaagactcagtgacagcccatctgctcacctatttaactcagagtgctgagacccttgatttggaggccaaagtctaggtgcatatatatggttcttttccattgtaatattcttatgtgtttttgtgtattttcaaatataaatacacaattgtacattgtttagtagcagaaaaactagaggagtggaatacggtgggaggcatgattattatacaaga

SEQ ID NO: 1803 - DNA, 4158 bp, Homo sapiens
tcaccatactgaacacaaacaattgagaacgtaaggatcacataattttgtcttttctgtatgtaatgtataaatcgagtatgaatgtacacatataatttgtatttagcatcacgtttttgaaggaatatgctactgtactaaaattatttttgtttggaaaaatgagtaatattttccattttcttttcatgaaatattgttaactgaacacttaaagctgtatcatgtatttatcacatggaatacggttaaatgaatatttaaagctgtatcatgtatttatttccatgaaatattattaactgaatattaaagctgtatcacatatttaattgtgtcacagttttacatttaaatagcttaaagcttatataaaagaaatatgggcatatattcaatctatacattgaagaactaatcaactcttccttaagtccaatagcagccaaatttgagaggtaaaatatatatttttggaatgatttatagagtgcactgaagaagaagataaaatgtcaaagaccttttattattattacttgataaaaagaaaattgtagaacaggacttaattctttaaaactattcttttttaaaaagtttgaggctcacaacaaaattgagactgtacagagattgaacactgctttatatctttccttcattttcttcactcaagtcttgcttacttcaaatatctctctgtgtttcacattaattctacttctgtttataaagttattacccactacacatgcatattcctccccactaccaacattctccaccaaagtagtacgttagttacaactggttaaactacattgacacctcattactatccaatctctataatatacattagggttctctttttgttgtatattctatgagtttggacaggtgtataatgaagtgtctaccattatagtgtctttcagagaagtttcactgccctaaaatatttctactctgtttatttatctctgccctcccaacaatctctgaacctttcattttctcccggattttgcctttcccatagtgtcatagagctgaaatcatacagactggctatttagactggcttttttctgttattaatatgcatttacatttcctccatgtcttcttatggcctgatagctcatttctttttatcactgaataacattgcattgtctggatgtactacagtttatgcattcatcaacttgattaaattttgaggtgtttaattaataaaaaagcttggccaggcaccggaactcatgcctgcaatcccagcactttgggaagccgaggtgggaggatcacaaggtgaagagatcgagaacatcctggccaacatggtgaaacctcgtctctactaaaaatacaaaaattagctgggcgcggtggtacatgcttgtagtcccagatacttgggaggttgaggcaggagaatcgctggaacccaggaggtggaggttgcagtgagccaagatcatgccactgcactccagcctgggcggcagagtgaaactgtctcaaaaataaataaataaataaataaaaataaaaaaactcacagatttattcctgctcctaccacctccccaagatcagcccactttttttaaatgtttctttatattatattttcatttagttttctgaaagcagaccctggtcctcaatctatctccacaggagttatttttacaccctactctaccctttatttatttatttatttatttattcatttttttttcttttgccctttccctaaatctggctgaagctcactacttatcttcctcgattgcagttcactaccctgaaaaaagtcctttttccttttaagaagtttgcactaatctaatggttattcagaagcttaggagacaacatgtacggcaaccaaaaagttgcaagcctgacttcttgactacagctgagatggtaaaatgataacatgaaatagtaagtgagatcctttctagcagcaatagcctctggtgaggaagctcaaaattctatttttaattaacaaaggccaattttacacacccagtcatcagtgaaattctctctttacaactaaaatgaaacataaagctgggcaaaacaaaagggtttgtttgttttttggcctcaagtgatcagagctaaatattgcttcagagtaaatattgcaattgacacttaaagtagtataatctgcagattcttctacttgccctaggctatactactttaaatatttcatcacaaaagtgaagcaaatgtgtgtgtgtgtatatatatgtgtgtgtgtgtgtatatacacatacacacacatatatatgtgtatgtatatactacaatagtacaaaataaagtgaaaagtaagcattgtaattagagcgtattagtcttttaggaataattatcttgtacttagcatttatttctgttaaaataagttcattatatatacacatacatacatacacacatacacattcttttcttcaaagctttagttataaaaagtagttagcattagtcatatcgaatgttgcctatgattatcacatttctaagcacatgattttcattatactccaatctagacacttcatttcttgaaacaataacctcaaaagttgtatttaatagataattttaattccagcttcaggttcaattattagcagataagttttgggtagctgttaaattagtgcctctggtccagtttgtttcattttcaaacacttgcatttcatataatgtaaacagtgacattttctctatttcttaatgaaatagtcaaaaacaataacatggatcacatttctaaatttataaggcaatacaacactggcaatttagctttttcttttaaaatattggttcaatttacagaaacgtatcagatttatttatcacatagtataattatatttccaacatccatactattggtcataatgagtagcatagataatcagaataaaaatagttgatattagtattgtcatatatttcatgatttttacacttaatctttcaactatgcttgttgtagtatattataattatctttcattctttatgtttacccaaaccggcagcaaaattaggtagatggcattttcagtgaataagaaatgtaatagagatggtgattccttataaagagaagacagactgtgagatacagtccctgatatgaaactgggatcagacaaacctctctgagaacatactctggttttcatctgtttggacattggcaaaaaccccaaacaagcaattacagggagaaggacttaaagtataggtctttggggataacgttttaagagcagagtaacctctgtgaaggaacaacattaataacagctctggttgtgtgcaaacaatacttttgtacagtggtcttatttgaccctacaattctgttttaaagatgagaaagtggaaagtcagtaagtaaactgttcgtgatcatataccagtcagtcaacggagcaaaaaggtgaagacaaatcatctcattccaaactttggactctttttaaaagcagtaaaaatgagatctgtctacaccagtgttatccaataaaattttctgaaggctgagttcagtggttcacacctgtaatcctagtgttttgggaggccaaggcaaaaagatcatttgagtccaggagtttgagcccaacctgggcaaaatagggaaacttcatctctataaaaaaaaatttttaattacccatttggggtggcatgcatttgtagtcccagctacctagggggctgagcaagaggatcacttgagcccagcaattcaaagttacagtaagctatgatcacaccactgcagtctgggcaacaaacagagcaagattctgtctcttgaaaacaaaaaacagaaaacaaaaaacaaaaaaactttctgcactcttcaatacaataaaattaactacctatgtctatttgaccaaaattattaatgaatttaaatttaaatagcagtggatagctagtggctaccatatcaggttgtgcaggctctatactgtatgcagatggataattgaaagttatttaaattattctcagtaatttgaatatatataagtatgggacaaaaataattaaaccaccacatattaaaag

SEQ ID NO: 1804 - DNA, 110527 bp, Homo sapiens
gacaccactgtcatttctattaggcaatccatgtattacagagtatcatacattcagccactttcttcacacacttcagagtacagaagtagtagcatgagtacatgaaaggagaagtaggatgtctgggatctgttcccagtgctacaattgatgcactattcttactccctttgcattgaaatctcccatctgtagcacaaggataatgacatagtacctgtttgtttctaaggcactggaaaattctctggtagaagatactatgcaaatgcagagactattattacaccaggaagacttgaaaattgcaagttggtgtgctcatgactattaagcagttgacacagtgacaaaagagagagcatctttcttcaaggcatctaaaatcaagtattgctgaatatgcagctattctgaaaaacatatgtgcaaatatattcgttttaatgaccttccaactctaactcatcaataacccatttaaagcaatcctttccaagttatcctgactccaacaaaatgcatggaatccctaatcactgatattttttataatgcaaagctttctgaaagattattctttctccttgcaaaatatttgctttactccagaatttcagagagcattctggctcattccactaagattattccaaaatataaaaacatttatccttcaatctgctaatcttggaataatcaaacttacagtacagtggtggacaggcatccaagcaggggcttccactgaacaattctgggctgggcatctgccttggttttgctgcaaataagtaaaaattatattatattctatttattatgggccagtatgtatatatgctagctgacatgtttattatcaatatgtttattaccttatttataatcatagagagagaatgctttgttggtgcaatgctgcagaaaactaggtacataatttctactcttatcaaagcataagaaattatccttttccttttttgttactctaaggactaggtttctggcaccaggctgtctcagcatctggccttccaggcttcaataccaaccacctgagaactcttacaacccataggctgactgttctcttccaggctcctaatcaaccctgaaacatgctgtactcctgtaagatcacatgagtcaaggtatagaatggctgtttatttgtctctgtttccagactataagctagtgatggtgattctctctagagtgtttcatagaactccagaatgttgggttgaaagggatagatctcagaggccttcttatcacatgaaaaactgaagtgcagagaaataaaacaattttctcaaggagtcagaaatttgacattctaaaccattttccaggcacttctttatacaaaagaaatttatctctagttaacctatacttttgttgtaattcctgtaaatttacttctaattggcttttaaaaataatacagtgctttactttcaccaacaatactgctacacccctttgataatgaaaactgattagtccaaaagggggggaaagattttaataagccatactttatcttttatttttttcattgtattctcagtgataatataggcatacttataatattaataatcgccataaaaaccacagctgtgatttactgaacaactaaatatgcaaggcactattctggacacattatattattactagtccccacaataaacataagtaggagtattatgctcactttctagtggagaaaacagagacttagagaggttaagcaacttggctaaaactcaacctactagacagcagcatctctgagattgcagcaagactctggctgactctggtgcccatgtatgctctttcttttatgagaagttgcctctgttattttagactgtctctttaatgggaggtaagccatgtcatcatccaatctgattttatctaatgaatgatcctaacatttctgatttaactgaataaaatactgaattcagtactcctatcacactaaaatttttgcctgtgatttgtaagctttttagagcaactttatttggttgatctatttttaaggcatcactaagccctaaaatgctgtatgagtgactatggataaagtcatcataaaaataaacttatatcatcaatctccatgatcaatttctttaaagcaaaatatgatatgcagcagcagcagcagagtacagaaggtacactggtcagataaccacaattttaagctaattttggccatgtgcttgctgccatgaaatgctcttgacagtcacaactgtgaaacagtgttagtattttgcctaattcacagataatagatatagattctcctcagatcattatcacaatttgcaaggaagctactaatgagaacacacaacatattcacaaaatatgacgggtgcataaataaggtgtgtttcaacttctgcggtgctcagcatgggataaagaaagatggaaatgtgtgtttctgttttgccttctattattacctgatttctgacactaagatcttctcgtacgtgttttaactaagaaaattaacaatgattttacaaggccagacaaataaaaaagactagtgatgacacatgtcatgtgaacataaattattctttaatcctattgtatgataagcaaaaaacattgaaacagaagttagaaccttggattttagtttagtgttcccattgatctacctgtggaactttggaaaactcactttaacactttagaccacacttttctcatctgtaaaatgagaaagtttcttggatccatcattcaatgtggagagaggaagagccaaatctacccaaagatctttcccaaactttatagttctaccaagaatttaatatttggttttatctaccaaagtggtataccctgcagttgagatcatttatcattctgatatactgatgagacatcttttagggtcttgggaatatgaacaggaaatggttatttccctgtgagtttcagtgctagcaaagatccacaaccactagactagatggtctcaaaagagccttccacttaagtgtggttactgaaaatcctaacctcatgttttgtctaccacttcgctctacttctaaagaaggcaagatctaacatggatcagggaacctaccacagcaggtggagaaggaaagggatttaaaattctttttcctcgaagtcttcattctccttcttcagtatcttttgtttttaacatttaatgtgtacactgtggcataacagagtttgggcctacctcctactcaaaagagtaggaggtcagctccttagaagcccagctagaaccagaataaacactaggggaaaggacactatcatgtctaactcttagttaattcttaagccaaaaatcaagggagaacattagaattccctcaagggagaacctagctctctaagcaaagatttaagatagaagttggtgacaaaaggtaaagctttcccaccttccttctgtctcattcatctatccaggatgtttatacctgtagattagtgatatgtgactagaccaggattcggggatttgcaatgctgaccgttaaaaacatgtcctcttaagagacaaaactatcaatgggtcttagtcttttaaaaacagacaggttgatgtctccaaacctctcatcttccttggttatctgtttctcactttagaatcttgacatatttcattccagaatattctgagaacattagctaaatatgctgaccaattacacctgagattgattgtataaatatgtaactacaaagaactcgaaaagtgacctagagaaccctaaagatgttcttctcaaacaaccccatccctccaaaaacatgggaatatttttttttgtgtatcaggggcttatacacagttagagtgctttggagtttagaaatgcttatatatacattgagccctttcatccccagaaaaagttgtgtgtggcagagtgagagatgattcatacaaataaaattttgacctaaatgtttcattaaaatagcatgttcttttgaaagcagagtaagagctgaaaggttctgttgttctactgttcacagtaaaatgatcctcataaacaaaggagttttttttcggggtgggggtgcggtattgagaagtattgcatgatagaactgtacacatatttgctcattcatttacccatccctcagttaccaaaatacactccatgaatggtacgttaggtatacatatagattttaaatttagaactaaaaaatttaaataatccttattctcctaaagcccccaaccttttaggagatacaatacaatgtgctgagtttaaaacagggttaaataacaggaccattcatccattcatgtagttggtcaacaagcatttattgagcaattactaagtgccagctattgcattaggaataaggatatatcaagagtcagtatctgcctaaaaaagtacttattctaaggagaaagataaactaataaagctgcagttataaagcaatattactgatatgggataaataaaccatttcatgacagatcaaaaatattcactgcactcattcttggggcaggagtaagaaatgaacaagcgtaagggaaaattatacagaggaattgaggcaaaaggtggaagtatttaactctggctgggtaattcagaaatgtctttttgaagagacacttcaggtttccaacacagttttaaggaggcgaaggtgtaagaagagggcgttacaggctaaaggtaactcaaaagaccatctgatagtgcaaagtaaagacattattggccttgtcaagaaactcctcaattctggacctcagaatcccaggactgaggagaaagaatgattttatgctatacagagagctgagttcagcctttccctttatctcttcttcacaagactaaatggacagcagggtgtgggataaatgaatcctaccaggaagtggacatggaaggacccagatctgatcctgtaaaacacacaagaggccctcctgagtttaatctttgaacaagcatttcagctgtcttactcatccgtgagactctaaggtatttgacagatgaagaaaaagaggtcaaaacgtgatgcccaaggagcagaactaagtggctttttgcatgcagaactaaaatgacatgcaataatgtgtatgcaaatggactgtgagttgtaaagtactttagaaatgtaatggataattataaagcattaattatttgaaaattaattttatgagctaattcttgttattaaaattactagaacactttctgacttctagtccaatatactctctagcacatcaagagttaaaaattttttcaaaaagtttgaggaaaaacgactcagaaagtgcctccaaatcatcaatttcatatatttctaaatatagagatataatatatatctatatttgtatgtatgtatctacatacacatcatgtgttcattatgcatcatccacataatgtgtctatagatacatatatacttacaaatatgatttatgtgtgtgtatacaggtgtgtattaaaaaattattctggcaaaataaaggttttcattgaattagttttctaatttcccataaagacatgtaatttcagagtgagatgtttaaaaaaagagaagatcaaatcttgccatgtgctaatgtaaaatacattataggtggaaatatgtgcacaaaatgttacattggaagtcctaagacaccaagatataaaaatgagattccaaaggaggctagaccacgtgtgcaatattcaaataaattaccaagaaccaacttgaggatcctgaatcctatctataatgtaatataatgctggtatacaaaagttagatgactaaagatttagaaagggggagaatatctttgaagaggggttgagaagtcttacatatcacctacaattagcaaaagaaacttcaatgggactgcacctagagcttaacataacttccttgggtttaggaggtcagtatactgggatttgactctcacctaagaagcttaaccagtgagataacgtggcaaattggttcttaagtgagaagtggcttcatatgggttagcctgcactctcagagttcgtcaaggcaaaagattcattctggagccattgtaacacctgtcaagacaaccctccatatagggtgggctgctgtaaaatgtgacgctaaggaaatgcctcatccacatcataggagatttaggcccagaaggggaaacttccaaagactgaggaaagtgtccatgagggaaaaactcaagccagacattttctggctgcgttaaaatcccagatccactgtttgctagctatgtaaccctaggcaagttgctttacctctctttgcattagttatgaagattttaaaagttataagtaaagcacttaaaactatttctatacataatcagcactatttgtcagtaattttcttcctttttggttattcttactgttattatatgtcaggttcggaaggcaaaaaacacaattccagtttaataagaactttccttgtctccttttcttatttccctcttatgctccaaacttggaaggatcaataaccaactagtaaataggtaaatagaaaaaaaaaaaaaagtaatcgtaaataggaataaaaaaaaaaactagtaaaaaaaaaaatgaaaagagaagtctatgacatccccttcccccaaagcagatgtcctgtctgaagaccccacagtggaaaaaagagaatctttcatctggaatgtgttcagaattttgactaatatttgggactgagcaattttaattaatacattgggactgtatttgtgatattaagtgattgtaggacttttcatttcctgtaaatggaaagttatgagaatacccgttttcatttagagggcagggtaaggaccactgacattaagccattttaaacaaacaatggggaatccaaaataaaatgacttctattattacatcccatgagtattccttgttcaatgtgtcaattacagatgccaaacatactcatggttagtgttaacttttttcattcaactttgggcatattcctcaacatatgacttcatcccttcctgggcttatccttccatttgcttctttttattttctcaggcttcaaaagatgtttaaaataagttggcctaatttgtttctgaggaaatccttactaaaactgaagccatgctggggagtcatgaatttgcctcttttgtaaatgaagaaaatgctgctgacctattctccaaaggatgctgagaacaagcgtttttcagtgggcagtgatgatggtgctgagtcatcctcaacacttttcaaaatcctttgtgacttcaggcagacatttgcccaggttaacagaggtgcagtctgtggctaactagtgcataagaggattaaacactctacattaaaatattctaagcacctagctacccagattaacagtaatgagtggaataggctctgagttttcaagctggccacattaaaggattataaatggaaaccattgttgtgacttgatatttcagggtatcaatggggagaggacagcgggctttgacttaggaagcatttcctagatgtatgatgaaataatacattgagcaccattagatcccaggcacttgacatgcattgtcagctcattgtatcatcacattaaccctagatagtagaggagagagtttaataccatgaggaactgactggacccgggttacaatgccagagttttcactttttacatctgtggctttggataaatttcttaatctctgtgagtttcagttttctcatccataaagtggaaaaaataaaacctagcttaaggaattattgtaaggattataaaactatatacattataatatatataacatatatgtctaggggcctgatatatactctaatagtaataagataaatactatataatttacatgttaatatctatcttattaattggggatctttctcctgtttcacttagctcctctgagtctatattcttgtatctgagtataaaatagtaatatttatctcacaaggttactatgaaaattaaatgagaaaaagtacatgaaagcgcttagcaaatgtcaagaactttaaacttaagttttgtttgtaacttttttgtcagtatatagaagatggaaagaatgtctgaaatactgcagcaatttaagataactaaatttgggagccaaaaccgattctgcagtctgggattatttacttgaaatcattggttataaatatttctaaaaaatataatatggtattttagtattttatggaggcatgtcccaatattctctgaagctctgtcagtctccaaagtttgagttattactatgcatagttgaatgcaatagagtaatttaagctactaaatacaagatttaaaagcatagttttgtgaaatatttttaatgtaattaatatttgcattctgtcattgcatcctagtaatcagatgagaaaaacggaatgggctgtaattgtacttttctccttgcaaaaaggaaaatttggatattattactactatagaaaataaatattttttcattggcagatcttatctattataaactacaaagtctcatggaaacataaaagactgtaacttctaaaacaagctacttttttcttccaaacatatttataaattcacttagtaaaaatatatgaaatttcaggaccccaaaataaagtcaaacctttgaagaaagaaatgccattcagaaacaagatgaaagtaattcacttctattctctctgctaccatagagacaaagaaaaaacaaagtaaagagatttagcacacttaattcttcctgaaatttataattaactacatgggaaaggtaacaattaccatatttccaaagaataaagaattttaaaagttgagcttttgataagacataattacaacctattaaatatgcaattcatacaaatttgcttatgatcttcttgaatttcaaaaaatgcatatacattggatagtgttttctgaaaagtacacatggaatgccaccaagttaattgtacagagctttctcttatcggaggattttctcagttacctaaaatcttggcaaaacctaacacaaagaaaagggtcaatggatattacttgcatatatgccctgtcttcctgacacctatgaatatgtattttgggacaaatgttaatcaacaagaaaatgtgcaggcttttgtagatcaagtgccatggccaacatcaagcaatagccagaacggactagcaattagatatgttctcagtttaaacagaactttagatttctaagtaaattatgggtgtattaattcaggacagttttattttaagagacttgcaagaaaacaccatatctagaaatcctaagagattcaaaacaaagaaagggaggaagagtttattttgcttaaaatgtatactttcatttatggtttctttagcaaataaattttttaaatttttatcattaagaatatcaagaaattatccttgtaatgtcctatttagaactctatttaaaaacaaataatttattttattttagggtatcttaaagacagcatcaaaggttatatttctcattgtaaaagcatgaagtatgcgagaggtaagctaaaaaaattaatactttatgaaatgtgttttcatacaaaaatcaaaattcttgctggcatagataataaatggtatgatttatgtcttgaaatttgacttttggatattcttttttgaaacataattaaatggtcttcgaggagactctactgctaactacattgctgcttggtaaagtggtataatagattattctaagtcatttctgtctaggggtttcagaacaattttaagggaacatttgaaagtctgtaaagcttttaactcagatcttaaccacagaataacgtaacatccattcagctcctgtatgcatagtgctggtgtcatctgtggctagttggacaaattccaagtaataattactattatagttttttaagttccttttgtaggttacttgggataaagccatttaatgatactgatacactttgttctctgaaatgtaaaccagtataaaaaagtagccgaactgctgtgaacctcttcctagacaagtttgtatcctgaaagttgagtaaaacataatgtattccacttaaaaaaattatattatttctccaattattttataacctgataatttaggagaataacatcattttttaattttctattgcacacctttctaactcactttaatgttttcatagtaaaatatactacattaatattgttattcttttatagtatatttatgataaatatgttatatatatattataaagtcaaataattttccccaaaaaataccatgctatattaaatcactaagaaattaaatgaacatgagttggcattcttttatcaaactgaaaagcagatctgactgctttagtttttgtttaataaaaaggtgcaattgtcttctaagtattttgtacttaaattttagaaatttcaattatgatcatgataatttggtttatcatagatgtgattcaattgccattttccaggtgtatataaggaattttacctctattagtccatttcttttatacaaaaatgacacttccaagtatcatttcaggctcaccaaatattcacagataagtttaccaattggctgtctcttaactgaatagtttctccatcagagtacaaagatttctttcacaactatttattgtgaaatgcacattatatatacacatgtacatatgtgtgtacatgtatgtatatatgctaaaacatttgtgtatatgtgcacatgagtctatatatacacacacagaagtacatggatatctacataagagtgttgtgtgtgtgtgtagtatgtatgtatgtgtgtgtgtaaattagaggaaggaagaatttcacccactcattcacttattgaacagtgaaatagctatcaaatgtctgttaaatgaaagaatcaatcaacacttgtagtacatctgccagtaccatggtaagtgatcagctataaatacaactaagaacttcccctgtcctcaaggaattcacattctagcaagaaataggcacatggaaaagctaactacacaaccagataaagactataacaaagatgcagacaatgtgcggagaacatggaggctgatgggctcagtctagtaggacaataccaaggaaagtacttaaagagaaatccgcatttagctgaatcttaaaggttaagaaatgtattagggaagtatcaagctaggaagttgagaggtattccaggcataagaaaaaacaggcacaacgaagaaacaagaggatgaaattcaaattatttggggaaaccaaatgttattgattatagttgactaaggcatgaaaggtagtgggatctgagataggcagttaggcaagggatacaacatcgagggccatgtgctgcaggggaaacaatgcagactttatcttgaagggcagtgcttctcaaaccttaatgtgcaaaatcaactaaggatacaaatcaattatcgatcttatgaaaacgcagattctgattcagtagtttcacacggggactaagatcctgcatttccagcagttttctagcagatgatattgcatttggtgaacaaacaaaattttgaataagggagcagtaggggacagggaatccctgaaggattataacgagagttgcagagttgtgatatacatgcaaattatatatatatatacacacacacacataaatgcacacacatatacacacatatatatgtatatttatacacatatacacacacatatttatacacacacatgcatgtatgtgtgtctgtatatatattatatatatatatatatatattttttttttttttttttttttttttgagacagagtctcgctctgtcgcccaagctggagtgccatggtgcgatctcggctcactgcaagctccacctcccgggttcatgccattctcctgcctcagcctcccaagtagctggaactacaggcacctgccaccacactcggctaattttttgtatttttagtgaaaacggggtttcaccgtgttagcaaggatggtctcgatttcctgacctcgtgatccgcccgcctcggcctcccaaagtgctgggattacaggcgtgagccaccatgcccggcctgtatgtatattttttaagggaaggttcaagttaatggtgtggaaaatgtataggagtggaaagataggaaaggtaggaagacaaatagggattctattgtagaaatccaggtaagaattagtgagtctctgaaaaagaccactggtagtagaaattgtaaataaaggacagattataaggaatagaataaataaggattggggctgtgggagatttaggaataaataaaaatcaaggttaactcctacttttctaaccatgacaactgggatagtggcatacaaagaaattgagcacagagcagagtaggagaactgtttatgcttggaagactccagagagtaaacattttccgggaactttcggcttaaatttacttaataggtaaatagaattccaaattccaagaactcattcatttactctcaaacccgtttctcataaaacctgtcatctccaaaaggttagctcgagaactgaattacttagatacaaagaaagtgatatgtgtgggtaagcatattaaaacagagatatgaggggcaaaggttattttcataggcttttgaatctggtactatctttgaacgcacaaatggaagaagaagctaaaacatttggtatctttctctcaccagtaagaggctataaacctgcaaagtattattcactgaagccagaggaaatccccatcaccatgactacacaaatagaaatttgccaccagagtggtaactagctaattgaattagtgaaatttatccttcagtgtcagactcccagaaatgaggaaatgagagagaaagaggagagggaacagaaacaccatcagctgctatttattggctatgtgtatacatagttgctacactaaaccttatgtgtatgttggcactagctactccccttgtctgggatgttctttgccaagaccttcacaaaggtgatcctcttagatcttcttttaacttaagtttgcttaagtatttatgtgacctgtgtcacttaagattacttctaacacatatacagacacagctctcatttttctctaccatacggtgatgctaatggtaatgaaagatgccaatttatgctaggatatcttattttcaataatttctctcatcctttccatgtatagagtacttcgtacttttcaaatatataaactaatttgattctgtacaataatcctgttcaggaactactgataagccagtattattaccccatttcagacttgagaaaaataagggtcagagaggataaagtgagtttactaagattactagtataataaatggaaacctcaagtctatattttctgaatcttgatccaacacatattctcagattgcctttggtgaaacatacatacatgcaacaagacaggtccctcaggtagctataatcatgggtaatctgctttaagaaaatcttatattccaaacattcaaattaaataatggataaatactaaagggcagtgatgaattcttttttgtacatcatgaaagatttataatattttttaaagttttgagcacagtaaaattttttttttttttgagacggagtctcgctgtgtcgcccaggctggagtgcagtggcgcaatcttggctcactgcaagctccgcctcccaggttcacgccattctcctgcctcagcctcccaagtagctgggactacaggcatccgccaccatgccaggctaattttttgtatttttagtagatacggggtttcaccgtgttagccaggatggtctcgatctcctgacctcatgatctgcccgtctcggcctcccaaagtgctgggattacaggcgtgagccaccgtgcccagcctgagcgcagtaaatgtgtaaatgttatctaagttgtaaaatttcatttgcagttgtttcctctgcagacccacatttgtctgagaatataagatttatgtaaaggtcttataaaggacaatactctcagtctcatagctcttcatagcattgtgttgtttttactcacagaatcaaaaagggctaatgttatgaagtaacatcctgtaatcatgtttggagggaaaaccatttactacagatgtgttaacagatgattggtatgattcatataataaagttttattttatttctaaaagtttagttttacagactatggatatatgtctgaaaaactacaaatctacaactaattgtaattttaaattaagccctatataagtgcattgcttttatttaattagatatttaggttgagaaggaatgaaatgcaaagtatattatcaagagtatattttaactaaataataactttgttgtgattcaatcaggagagaataatagtgaatgggaacatggatattagagtcataaagacttgagttggaatccccactataaaacttattatttctgtgaatgcacctcatctttaagatatgaaggatcaccaggttggtctaaagactaaacgtgtttttattaaattcaagtaccttcaatgtcccagacattatacacacacacacacacacacacacacacacacacacacaagaaaaaggaacacagttcctttccttatggagtttctgtctagtcaaaagaaagacaaaataatcacacaaatcagtatgcactatgagttgctatgtgtggaaatgtggcataaaaatcagagtgtactccaagaatacataaaattttaggaaaggtagtgacatgtaaggtgacatctggaatataagtagaatttagatgggtggatggtcatctagaaaaaaaaataacaaatggaagtcgccgaaaccaaaacatggttgacaccttcaaagaacggcgggaagccagcaaggccaatgtgtcctttagtttaatgaaagatagggaaggtaacacagatttaaaagatggtctcgtccatgtattttcaacattcttggagtgtaaaatacaaggtataatgaaagaagataagacatgagagaaatttaggttctaagtcaaaagagaatcgtatactttggtaagaatttgtgtaactactcatctttcaataggttgctgagagtgatgttgttgggtttgtgtattagaatgatcctcttgcagctggatggaatacttaataaaagaaagttaagctattatattaatggcattagtatttcatatgtctgacactattaaatggttaatcccaggttattaagacagtcatagaatctcttctctttctacacaaaaaggtcaggttatgttaaattttccctactattagctgtatttatgctcctctttgccactcaatacattttttttctgatacatcaagccccctgttccaatctcccccacgtagacatgccaccttgcagacatttggttggaatgacaagaattagaaccagtgtcattggcaggataaatacaagaagtgcaccacaaaaaaagatacaaagataaagaagctatagaccctaacaaagaacagagtgcctactccctacaaggtaatatcctaagcattttatagttcttatctcaccgaattcttaaaacaacgctgtgagataggtaccctttcatggatgagaaaactgcagtgctgagaaggtcatccagctagtaaaaggggaaaccattattttactgaacaggtataagaatgggcaacacaggttgtggcagaaaataggagagagctcaaatcagggggatgaaatgggaaagaagtctgggcaagctgggatttggaaccagttttaatgatggatggaatatcctatttcctttaagataacaaatatctcaacttcatgatatttgtgacagggtgctgatctatctctgcatcctctatatcttgttactcatattggacaccttacatcccagccatattgtccttccattcttgaaatgtgcaattcattctctctctctccccccgccccccacccactctctctttctatctctctctctctccccacacacctgccagagctttgcctaaaacattctcccaaccccattgtggctttcattctgcaaatcagcttaattttcacttcctcaggaaagcctcccgatatttatccctgcctaccctgcaacaaagctaatcaggttctttaggtatccctgtatccctatcctcatttccatagcactctatattcattttcttatcagacatcactgctatttctgtaattggttgttttccccattagacgaaaggttccatgagaacagattgcctgttgtatccccacacctttcaacatgtcaagtgcatagtaagcattcaatatatacttgttagattaataaaatgaatgaataaatgtgatgcttctaccatgggagcaactgtacaccagcatgaataaatagctttgtctatgaacacaagaccactcaggaaaccatttgttgccttggtgatttgtttcattttctctacatgaagctctggtggaaaataaaaatcattttagcttttccaaataccttatttgcaaatatttctgttaagaatccacttacaaaaggacaagatgccaccttttaaaaattaaagtcataataaaaaatattatattcaccagctgtgataaaaatatttttaatgcctggcaataacttttatttcctttcagtaattctgagtgatttttaattcttattaaagatagtgggttgacagaggcaaagagtgaaatcatatttacaaaacagatgtagtattaactacatcaagaaaagcttcttttgtgctgcctggtccacttttcactctgctatgtgaattttattatgtacattaacctgttatacataataaaaatgaatagtaccatcatgcctttattaacaaattatagcagtaacttaacatattgcagttttatttgtagattttttttaaactttttcaaatgtataagtatggttaatggatatctgaaattatgccaatgtgtgattcacccactactactatttaagatacttaacctaaacaattttatcttcagagaaaatatagaataatgttagattcaaaatagaaaaggaaatacctcagagatgcaataaaatatactcattttaaagaaaaagacaatggtggccaaatgcctttgggtgcccatggtcagaaagtagagatttacttttcgcagttccacacttttttctgttcttatatcaaatcctttatgttattacatatgatacttgagaattcctaagcagtaaaagaaaaattctattgactccttgcatttcattaaattaggcagaatattctgcctgcgatccagaactattgtcctattgcccaatcatgtaaactcatggctctgcctaacattattttccttatattttagttgtgaaacttattgggattatttatctttcaactactcaaaacatacgtagggaattccattatataaaatgtgttgcattagttattggattgtgtttagccagtgttattgagatgacttcatttacctcaatgatcatactgaggggtattcattaaagttataaattgtgagttgctgaataaattatactatatacacatttttccatataccaggaattgtgctaagtactttacatactccaccacaacatcacttagacataggtaatatatccttttcgaagatgaagaaatcagtgtttgaggaagttaaacaacttatccacatcttaaaactaatacatgtcagaacaacaatttaaatccaagtctcgctccagtatcctgctattcacactaaaacatgttctttctctttctcagaagtgatatctgtgacaaaagagttaaacttgaaactggacagaaacatttgagaaaaagagatgactcaatcttctgaaagtgggttgcctgagcatttgacaagacttgggatccatgtgacagaaactctgtatttatgaatactctgatgatttcctagtctacaagatcttactccaaatctgatacattctgcaaatcaatctaactagactggagctcttaagactttaaacaatctgagttaaatggggtaagatctaaggtgggattattttatcagagcatttacacaaaatccacaatcatttccttccctttatatgtagaaacaaaataaaaatgattctccatcaccattctaactggcatgagatggtatctcattgtggttttgatttgcatttctctaatgaaaagcaatcattgaaaagtcaggaaacaacagaatgtggagaaataggaacgcttttacactgttggtggaagtgtaaattcaaccattgtggaagacagtgtggcaattgttcaaggatctaaaactagaaataccatttgacccagcaatcccattactgtgtatatacccaaaagattataaatcattctactataaagacacatgcacacgtatgtttattgcagcactattcacaatcgcaaagacttggaaccaacccaaatgaccatcaatgatcaaatggataaagaaaatgtggcatatatgcaccatagaatactatgcagccataaaaaagaatgaattaatgtcctttgcagggacatggatgaagctgaaaatcatcattctcagcaaactaacacaggaatagaaaaccaaacaccacatgttatcattcgtaagtgggagttgaacaatgagaacatatgggcacagggaggggagcatcacacaccggggccttttgaggggtggggggcaagaggagaaatagcattaagagaaataccttatgtagatgatgggttgatgggtgtagcaaaccaccatggcacatgtatacctgtgtaacaaacctacacattctgcacatgtatcccagaacttaaagtacaattctaaaaaattattctccagtatgtctaatagatccttttatattaccattatacaattatattttctagatttatcagcatccctctgctcattaatcttcttacaatctttaggaatgtggaacaaagacaaaaggaggaatttatctctatagtatgtccagtaggggaaaatggcagaactcagagctcacagaggtctaggaggagccaaggggacagtgagggactttcatgccaaggaaagggaaggaggaacaaaaatgctattaccaatggaaatatttctgttttcctgccactaaaaacttgacaaaggtagcggtcagctgtggtatcgaaatgtgctgtgaatgaaatggagcttaggacgtatcataattaacagttccagtctcacataaagcttctgtaaagcaataattgaagacagcaccttagccagagctattggaaagtgaacttattgctgggggataaggagatgagtattaaactaagatataattaaaatttccaaattgtgggcaagtttcttgtcaaacagtcccaagaaagtagagcaagggcatcccaagtgcatggccacttggggaaaaacagtaaagtatcaacagtggtagactaaatagataagatttgcagtctaaagtcctctaagaggtctcttcacctatgtccagcttttgaagcaatcatgcattatttaccatttaaatattacaatgtaactttgctgtatgtttgttctttaaagatgttatatacatcactctagaaatgttcgtggatataactaagaaaatgaaatttcatgtgggtctgtgttttgttgattcgtataatttatatgataaatcacaatactggagtaatgacatttatctcttattaagaatttaaagcaaaataataatatgtatcacctatgtacctgtagtcaataatatttttataagtaaatataaggcatatgacattttttattagataatgttttccaaattgaaggcacttggatttcggtattgatttaatttgtataatatagtagacttctagtttgggttctcattaataacttttgataacttatttttacaatattaattatgtttcacagtatctaaaattattataatttgggaataaataatcataaaacacaagtagatcagatttggtagtattgtctcaagaaaagtaacacaagggtaacacctcaggaagagtaacatatttaagaggatatttcctttagtagattacataaggacatacaatttcctacttaagattttttaaaatttattttagttgatttactgatttaactggaatactgcatgagatgtttggcaatttttaaaagtaaaataaggtattcatctaatttagaggcctagtcaactaactcaactagaagttttaggctttaaatccactaacatcaactgaagctgccatgtgatattaggccatatgggaagatatccattatgattttctggggcttcatttgtaaaagtaatatatttaaggtcatactatggggaacttggtttgtggctttgaaattaaataatcttttcttcagtggtaaaaggagatcacaatgggacatctacacttagttaactctcatgtactaagctattaattttgttatgtttaatagtcatctaatcaacgtgagatacaaaaagatatggttcaaattaactcatggtatgcttacatgcaaaatgaaaagggaactaatgaataaatgtctataattagtttttcccaaaaatattaggaatatctattcaaataatcagtgattataaaatttaaatacattatttagaactgatgacagaataaaataaaatgcttttgaaatgttttgctattttctgtaaaacaaatccataaaacgattgcctattgattttatttcattcccacttttatttatacttccaataatgcaaatatttgtgtataattaaaatagaattagctaaatattaaatattgtgtttgttttaactcagggccttgagatttttttcctttaaaataaatcactaaaatgcagaatatcagaattctccaatcagaagcaatatgtcaagtcacagtaaagctgattggcttcttcaaacacagaagacatggtttttaaatgaaaagctaattatcacactcagaaagactgccctgatatgttaagttaaactgatgtgtatgtgctacactactactatagatatttctattatgagctataaatagatgcaaaagcaaatcctgccataaaaaaaaaacaaaaaacaaaaaaacaggcaaattctccttccatttgcacaaacatgcaatatcactttaagaagttaaaatcacataaagacaggaccccccagaccctcagggaacaaaatgcccagcaaagtaaattatactaatcattttctctcatgaactggcagcacctactagaactgtttaattacgggaccagaataataatagaaaaatgctgcacacaataacagccctgtttcctatcctacctttgtggtgacaatgcacaggcaatccatcctggatccctacacaggactcagtacatggaaatcacaccagcaaatcagcaaaggtgagaaaagccttttggaaattgcacacagaaagaagcagagcttggattctgtacagacggcttttccaagggggcccctcatgggaaactcgagccctcctccatacagctcaaggcaagcaggattctgctaggcaccagaaaatcccctagaaatcagctccggcaaaacttcccggtggcttcctgggctccgtggctgcatggtcttttagcggattccttgattggaacaaggctcctgtgagtgccccgcacagttctatcgttgcgatgagtgtaacaccaagcaccagggaatcacatttcagctcttgctcttgtttctgaattctgatgtgctgcttcagtatactcataatattttctttgccaaagtcccccctttgttgccttcctttcttactaacactgagtaacacaaaaaactacccgtcccatctaccaaatggctgtcgttccagtgccagaatagcggctttggataataaaatgctatttattatgagcatgattgccgggagtctaaatgactcgaaagatatgactgaaaagctaaggtgcatgtggtactgcatacatcacatctcaactcacttgcaattacaagggcagcttcttacaaatgactaacagctggataaggaaaatcaagccagtgacataaggaaactgcggatttggaggtttaacttatagaaaagggttacatttctccttttttgtgtttacctatgtgtgtggtccatgacatatgcaaatacacaaacaacctgaacatataaatgaatattatgaaattggggtgggaggaggttctaaagtgtttacaaaacttccacattctgagtgaaaaaatgagttctttcccaaacttttccctcctcacttgctgtctgcaggcacttattaagtgggcagagctttgtgttgccttctgcagcattttaacagccaaatgattagcactctcccctcccccaaatccctccctttcttctagtaaagctgctactacatagacggcctttgaggtgcttgacaagcatcactctggataataatatacttttttttcccatcatcttagacacacaggcagtcacagactgaaacagaaaaacagacacaggagctcagaaaggagagagggggtgggaagggagaatgagggagagtgagggagagtgagggagagtgagagagagtgaatgacagaatggaaagcactgcctgaccaataaaaatcgaaaatcaatgattcgctttcactaggaagaaaatacatagtcaactggaccattgaaatatcaaaaataaatgtctagggacccatacactttatctcctcaggatactggcaggaccatttcccaccccactactaaccaccaccctcttttttttttttcataaaaagtatactttcttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaaaaagtatactttctatgataaacaatttggaaaaaaataatataaataatatgtaagacttctacttttcatgaattattgaggttctaacctcaatatcccaataacctcctgattgctaaataaatgaatgtctcagaaactgacatgtcattattttacccaaatgagagcactgttcataaagattttaagttcatagcaaatcaaatacgtgttctgaggaaaaaaagaagaaaagacaagctcctaaagttcaatttgatataaaaaccttcaaaagtggctcaaaaaatatttatagttaaaaaatataatttcttctgaactgctatcctactgatgtaagaaatttcaagtaagtttcaagttaaacaccaccaataaaatccatgctctggtccattccattaggtaactctgtcttatggttcagtaatttgaaaaggtcaaagaaacaccagtttgtctattcaccctcatttgttacatcatcacaataattattttaactcaatacttcctaagcttatctaagggtgcgtaaaaccttatatctttatgtaccagcgtgtttccctggcacaactaacatctaataggtaattgagacttactgccatattcatgttcaaaataattagtctttgtgtccctatagcaccttaaagttgacaaagaacttgtaacagtctcacaggcttgggaagtttaaatgacttcctaaaagcctagtaactttcaatagcaacattaaagaccacgtcccttaattccaagtccaggtctttgttagtcatagagacagtcagaatggagacaatcaggggttagacagaggaagtaaataaattggatagcagagtaagatgagtattttcacaaggtatcctggaagatgataccttcggaacttcattccatctttgcagagaggcagacacttagagaaaaattagcaaagggagcctgattagtcttctaacgttggtggatcacagaggaaagcactttgtaaactatagagacttgcagaaataaaacacagcttgtctagcataggttctagaataccttaggcagtccctaagtcattcacctgacacatgtttgttgagcactcattatgtgattatttgattaatgtctatatcaccctctaaaatgcactccttaaagatagttttaactctttatttccattgcctagactagtgtctcattcattcaacaaatatacttgagaatctacttatgtggaaacacaaagtgaggaaaagctagcaaaatccctgcccacaagagaataaaaaactataataccgtacagaaagcatttgggagtgttttacgtctacaaaatagaggcatttaacccagaatggagcagtgagggaaagctttctggagaggggccttgagctaagatgaggaagaaccataggagttaactagaagttaggagaaaagagaattgcgtgcactctattgtatttgaaaaaggaatgaatcagcaatatgttatacctttatacaatcagtttaataaatacatccaataaaagtgcttcagagcaagcattttacagcaagcattttacaaactgaatatgcaatctttatttgagaaagaagagcattgctcatataactttgagtacaagtatactgtaaatgcatgtacaatatgtatgttatatattcatttgtttgtattcgcctcaagtgattaactggataatgtatgtaggtttagatataagtacataacattttgaagtgtagacccatttgggttttccactttgtgtataccttatctttgattgattttcctcagatataaagatgatagaggataattcactcctttgcctcaagggaaacattatgttgtttttataattaacaaggtattgacatgaagcatttttttttttaacagacacagtgctcagttgggcctgtgattttcacaagaagtctttggcaagataaaaagcctcagcctgcaagctgctttacttgatattccttgaggttaatgatctaaaactagaaatatattgattcttagtaaaacctatcattgaaagtttgatatcataaaattactcttgtaaattacttgcactaaacctgtaccttaaccacttaaatccattattacttttattttgtttgtttccaacagggaaaaatatgtttagaagtgaagtccagtcagtgtctattctagaatctaagccccttgagggcagatttaatgtatatatctggcacctaatatggtactggcacttaagaggcacaaaatcaatattagtggaatgaaagaataatcacagctctagttatgctattttttgatagtttttaaaaaatctatttaaacttatgatcccttattcatatgagaaccatatatttatattaattatatacatatatacatatgtgcatacataaaaatttaaaaataaatatattggtgcatgtagctgaaggtatttgcaaataaaaatattttcattggaaaatccagtctgatgtaagaaggtatggtttagaacagtcttatctataatggagaagggcaatttctagctgaagtgttacaagtacaggatgctactgaaactaggtgcttgctattgtgttagaaaaacagtaataaatataagcatgttaataataatagtaatttatcaagtggctattatctgaagtactggggtaaatactttgtaactattatctcatggtcataataccctttaggaaataattataatccctattttatagttaaggaaactgaagttgcttgaggttctatgacctgccgtgacacaaaacctaggtgaccccaacacagagagtggtctatgttatttccgtctcatcacactgcaaatcctgaaatcgtttctgtccctctgggtccaaactgagagtatggcacaaacagatacaaaaggccttctccttagccaaaggtagcctggactccatgcagatgaactataaacaacctgtgatcctcctaaaaagataggttcatctctgggttcctatctgacaccttccatagcttataagggccttgggaataaccccagaaggaatggactccacattagaaagattaggtccaaaggaaataacaagaaatccacccacctggcctcctatccctgtctatctgttccccatatacccagaacagcaggcacacaaatgacatctgcaaagcttgttagcttagtaaaataaatagactgcaggcaggtcatggcaaaatgcctgccctcatttccaaactctccagaggtaagtaagaaattaggatcaactgaaaaaagactgaatttttcagagtttctatcattaaaaaaatcaggacagtaatggatcccgaaaataattcatgaaaagcaggagtctatgtattctgttcaagttaaatgtgtatccttacaaaaaaatataaaaactaaacaagcaaaattttgagtgaaccaataattgctaatgaaatgaattaatttttagttttaacccatcttttaatcatgatattcaattgtatggacctaaattttatgtcagtttttctcatgtgagttggaacatagttaaatgatagccatgtagctctcccagttattatcatcatcaaaatctaaacaacctttgaaattttatataaatggtaggttataatgtaaacattcaataaaaattgtgtccctaacaaatcaaagtttacataaactttgttgaacattaactacatttcttatgaggctcaatttttcctattatacaatgctgtgggttgagtggattccagaaatccaaatagttgtgtgcaagccacaaatctaaaaagctataatggtcaaaaataaaattttgctttcaagtcaatataaataacctcagcagtattgctaaatgccattcccatactccaccttcttataccctgatatggtttggttgtgtccccacccaaatctcaacttgaattctatctcccagaattcccacgtcgtgggagggacccacgggaagtaattgaatcatggatgccggtctttcccatgctatacttgtgttatggaatcagtctcacaagatctgatgggtttatcagggatttatgcttttgcttcttcctcattttctcatactgtcaccatgtaagatgtgtctttcacctcctgccatgattctaaggcctcctcagccaagtggaactataagtccaattaaacctcttgttctttccagtctcgggtatgtctttataagcagcctgaaaacgaactaatacatacccaaagcacactggcctgttacctgttcctcaatatagtgtttcactctaattcttcctccgggccttgaatttgttgtttcttctgccagaaactgtttttccctggatttgcacatggctggctccttctcatcattcaaggctctgctcagatgttaccacctcagcaagaccttcccaaactgatttcccctaattagaatctcttccatcccttctccattacatcatcccagtttatttcctccatatgattatcacaatccaaaattatcttctctattcatctcttactatctcccctatctgaagtttaccagtgagagcaggaaccttatgttttgtccatggcaatctcaccagtgtttagaacataacagatgctaaacagagatttttgaatgagtgaatgaatgaatgagatgcatcacatggaaactctttaaaaagtatatggctagaatcagcagtccaacatgaaatttgcaatgcaagatctttaacatagtttggtttctaaggatctgatttacactaacaatagtatttacaaacatacacataaacaatagttttttggattcaaaattaatttattttgaaataaattgtattgggaataattaaggtatacaacatcatgtaagatatatatacatagtaaaaaggttattatagtgaagcaaattaacatatttatcacttctcatatagttacccattttttgtttttgtgtcaagaacagctaaaatctactcatttagcatgaatcccatatataatacaatgttattacctacagtcctcatggtgtacattagctctttaggcttcttcatagtacatatctgctagtttgtatcctccagcctacatctcttcattcctcccaactcagtaaccactgttttattctgtgtgtgtattttttaaattttattttgtatatggtaagtatgtgtatatgtatacacacacagatagatagattccacatatatgtgagattatgcaatattttcctttctgtgtctggcttatttcacttagcataatgtcctcccaggctcctccatgtcatggcaagtggaaagatctcattcttttttaaagctgaatattattccatattatgtgtgtaccacagtttctttatccattcacccactgacaaacacttatttccccatcttggctattgtgaataataccgcaaaggtcatacgagtgcaaatatttttacaagattgtgctttcatttcctttgtgtatatgcccagaagaggaattgctgggtcatacagtgttgtatcttcagtttctttagggacctccatactgttttccataatggctgtaccaatctccattcccaccaacagtgtacagagttcccatttctccacatcatcaccaacatttgtcatcttttgacttttatttagaaatagtaaacaatttatatgacactcccaaaacaaagaaaggtatgcacagaataatttttgtagaaaatatgcatttgtaacctatctttttaaaaaattatgagtacatgatagttatatatatttatagggtacatgtgatgttctggtacaagcataaaatgtttaatgatcacatcagggtaactgggatatccatcacctcaggaacttatttttttttttgtattagacacattccaattccagtcttagttttttgatatatacaataattattgttgactatagtcaccctgttgtgttatcaaatactagatcttattcattccatctaactatacttttatataaattaaccatccccacttttcccctccatcaccactactcttcccagccttaggtagccatcattatactcttttctctccatgagttcaactgttttaatgtttagccacatatgacacagaacatgtgaaatttgtctttctgtgccaggtttctttcacttaacataatgacctcaagttccatccatgttgttgcaaatgataggagttcattcttttttgtggctaaataatattccaatgtgtaccacattttctttacccattcatcagttgatggacactttgattccaaatcttggctaagtgaataaataataaatacaggagtgtaggtatctcttcaatatgctgatttcttttcttctggataaatacctagcaatgggattgctcaatcatatggtaatttctatttttaatttttgaggaatctccatactcctctccatagtggatgtactaatttatactcccataaacagtgtatgagggttaccctttctccacatcctcaccagaactcattatttcctgccttttggataaaagccattttaactggggtgagatgataccccactgttgttttgatttgcatttcttgatgattaataatgttgagtatttttcatatatctattggctatttacacatcttcttttgagaaatctctgttcagatcttttgtccattttaaaatcagattatttgttttttttcccattgagttgtttgagctccctatatattagggttattaatctattatcacatgaaaatatttcctcccattgtataatttgtctcatttgttgattatttcctttgctatggagaactttttagcttgatgtaatgtcatttttctatttatgctttggttgcctgcacttctgaggtattactcaagaaatttttgcccagaccaatgtcctagagagtttcttcagagttttctttcagtagtttcatagtttcaggtcttatatttaaatctttaatccatttttattttatttttgtatatggtgagatatagggttgtagtttcatttttctgcacatggatatccagttttcctggcacaatttattaaagagactgtccttttcccaaaatatgttcttcacacctttgtcaaaattgagttcatggtagatgtatggatttatttttgcattctctattctgttccattgatctatgtgtctgtttttattccaataccatactggtttggatactatagctctgtagtataatttaaagtcaggtaatgcaattcctccagctttgttctttttgttgcccatgatggctttggctatcctgggtctatactggttccatacaaattttaggattactttgttatttctgtgaagaatgtcattggtattttgatagggatttcactgaacgtgtagattgctttcagcagtatgaacactttaacaatattgatttctccaatctattaacacaaaatatctttccattttttgtgccctcttcaatttcttttactaatgttttatcgttttcattgaagagatcatttacttctgtgattaaaatttattcctaggcatattattttatttgtagttattgtaaatgggagtttttttcttggtttctttttcaggttgttcattgttgacatttagaaatgctaatactttttgtatgttgattttgtatcctgcaattgtattgaatttattcttcagttctattagtatagttttttggtggaatttttaggtttttctaaatagaagatcatatcagctatgaacaagaataatttgacttctttcattccaatttggatgccctttattatttctctcatttaattactctagctaggacttccagtgctatattgaatagcagtggtaaaaatgggcatccttgtcttgttatatatcttagagaaaaggcttttaatttttccccttcagtctggtactgtgtaggagtctagcatacatagcttttaattgtgttgaggtatgttccctctatgccacattttttagcatttttgtcacgaagagatgttgaattttattgaatgcttttcagcatcaaatgaaatatggttttatccttcattcggtcaatatgatatattacattgattgatttctgtatgttgagacatctgtgcatccctggacgaatctcacttggtcttgatgaataatccttttaatttgttattgaatttggtttgtgagtattttgttgaggatttttgcatctatgttcatcagagatatttgcctatagttttcttttttgatgtgtctttctccggttttggcatcgtggtaatactagcctcatgaaatgagtttggaagtgctccttcctcctagattttttcaagtagtttgagtaggattggtattagttctttaaatatttggtagaattcatcagtaaagtcattaggtcttgaatttttctgtgatgggagacttaattatgacttctgtctcattacttgttattggtctattttggtttcagatttttttcatggttgaatcttggtaggttgtatgtgtctagaaatttatttattctagattttccaattctttggcatatagttgttgatagtatctctaatgatcctttgaatttctgtgatatcagttgtaatgtcacgtttttcatctgattttatattgcggtgtcttctctcttttgttctcagtctggctaaaagtttgttgatttactaatttttgcttgttttgcttttgcttttctagttccttacaatgtatcattaggttatttatttgaaatttctctactttttaatgcaggtgcttattggtatacttccatcttacaattgcttttgctatatcccataagtttatgtatgttgtgtttccattttcatttgtttcataaaatcttaaaatttccttcctgatttcttcattgacctgcttgtcactcaggagcatattgtttaatttccatgtgtttgtatagtttccaaagttcctcttcttattgatttttagttctattccatagtggtcagaaaagatatttaatataatttcaatgttttgaatgttttaagactcattttgtactttaacatatggtctatcattgagaatgacccatgtgctgaaagaaagaatgtgcattctgcagcttttggataaaatgttctataatatctattaggcccatttggttgacagtgtagattaagtctgatgtttctttgttgattttctgtctggatgatctgttcaatgctaaaaatgggttgttgagctctccagctagtattgtattgtggtctttctttctctttagccttaataatatttgttttatatatatgggtgctctagtgttgggtgcatatacatttataattgttatatcctcttgccaaatggactcctttatcattatataatgtccttctttgtctcttcctttagttcctatcttagaatttattctatctgatataggtatagctaattcctgctctttcttagtttacatttgtacagaatatctttttccatccctttaatttcactctataggtgaagtgagttttgtaggcagcatataattgggtcttttttttttttttttatcagtttagccactttatgtttttcattggaaagtttagtccatttatagtaaacgttattattgataggtaagaacttactcctcccattttgttatttgttttctggttactttgtggtcttctcttccctccttccttcctgtcttcctttgtgtaaaagtgattttctctggtagtatgttctaatttcttgcttttacttttctgtgtatctgttgtgggttttttgatccgaggttaccatgaagcttgcaaataatatcttgtaaaaaataattttaaactaatgacaacctaactgatttcagaaacaatgcacaagcaaagagaaaacttaaaaaaaaactctacactttatcctccatgttctttgacttttagttgtttctatatatttttatactatctatttcttagaaatatgttgtagttattatttttgattagttcttttactattcctattcaagatatgagtggtttacacaccacaattacagtgttgcagtattctgtatttggctgtgtatttgctgttaccagtgagttttgtaccttcagatttcttattgtttgttaatgtccttttcttttagattaaagaactctctttagcattgctcttaggacaagtccactgttgatgaaatccctcagctgttatttgacttgtaaagttttatttttccttcatgtttgaaggctattttccctggatatgctattctaggataaaagttgtttcattttttttttccttcagcactttaaatatgtcatgcacctctatcttggactgtcagatttccactgaaaaggttgttgccagatgtatgctcccttgcaatgttgcttgtttcttttctcttgcttcatttaggatcctttctttatccttagcctttgggaatttgattattaaatgtgttgaagtagtcttatgtggattaaatctgcttaattttctatgaccttcgtctacccgataatattttttctaggtttggaaatgtctctgttattatttctttaaataaactttcttacctgatctctttctttatttcctccttaaggtcaatacattttacattttcccttttgagactgttttctagatctcataggtttgcttcattctctttattatttttttcttctttcccccatggctgttttttatacagcctgtcttcaatctcaccaacttttccttctgcttgatcaattctactcttcagagattcgaaagcatttttcattttgacaatagaaatttttcagctgcagaacttctgcttgattatttaaaaaattatttcaatctgcttgttaaatttctgggataagattttgaatcccttctctgtgttatcttgatgctcactgaactttctcaaacaactatttttaattctgtttctgaaagttcatctatttccaccactctagaatttgtcactggtgacttatttagtttgtttagtagatcatgttttcctggatgttcttgatgcttgtggatgtttgttaatatctgggtatttagaagttaggtatttattttaagcttgcagtctcagcttgtttgtacctatccttcttgagaagggtttccaggtattcaaatggaattgggtgtggtgatcgaagtctctggtcactgaagccatatcaacactgggagataccgcagaactagtaatgctgtaattcttgcagactcctagaggtaccaccttggtaggcttgggtaagatctggggaattccctggattactgggcagcagtctctgattctcttccctcacttctcactttccccaaacagaagtctgtctgtatgtctgtttctccctctctctctctctctctctctctctctctctctctcctgagcttcctggagttgggggagggatggcacaagcactcccaaagctatcacagccaggactgtgctggataatacctgaaggcatcacagtatttgggtcttatccaaggtccatggctactctttcctggctgctagtgatgtttcttcaatgcccaagggctctttagtcatcaggtggcatatttagccatgaaggggtccctcctgtcaggggagcaggttcccttctagccaagggtaggtctagagatgccatccaggagctaggacctggaattaagggtttcaggatccagcgtggtgctttattttaccgtggctgagctggtacccaggttgcaagatgaagtcctttgtactttttcttctgctttcccaaagtctaaggagtctttcccaagctgaatgcctggaattagggaggggtaacacaaacacttccttgggtgtgacaactagtgtctcactgggtttcatgtaccccaagtccactggccccaagcccagagcagtgccaggacttatccaaggactgcaaaccttgttacctgactgacattcaaatttatctaggacattaggctactttagtcagccaatggtggagctaccccaaactcaggttcctaccactggggtggagaattcccctttgaatggagctagtctaaatgcttcatctgtggacaccggtggaattttgccctatgttgtattctgctgtgagagggcagaattgagttccaatgcaatgtctcacaatcacttcactctctctcctgcgaacacacagattttctgaatacatgccatcggttggggaagggtggtataggcaatgcgaaactgtctttcctaccttctttagtgtctctttccttgatatagtatttaagccagctactgtgatcactcacctaacctttggttcttatgaaggtgctttcttgcacagatagttattcaatttggtgttcctgcaggggggataatcactggaacgttctattcagccatcttcctctgcctccctcctatctattgactttttgataaagccatcctaatgagcgtgaagtggtttctcattgtagttttgatttgcatttccctgatgattgataatgtttagcctctttttatatacctgttggacatttctgtcttctttgaagaaatatccacccaagtcttttgcccatgttttaattagttatttgttccactactgagttgtataagttctttataaattttggatattaaccccttatctaatatatgacttgcaaataaccattaacttttcatttaccaagtataaattttcatatgcataatatcattaagtattcataaccaatgaattaagtataattttacaggtaaagaaactcagactaagaaaaactgacttacccaaagttatttaactactgacttgatgaaccagtatggtcaatattcttttattttattttattttactttatgttccaggatacagacgcagaatgtgcagatttgttacataggtatacgtgtgccatgggttgctgcacctatcaaccaatcatctaggtcttaaatcccacatgcattagctatttgtcctaatgttctccctccccttgccccccaccccctgactggccctggtgtgtgttattccccacactgtgtccatgtgttctcattgtacaactccagctgatgaatgagaacttgtgttgtttggttttctgttcttgtgttagtttgctgaggatgatggtttctagcttcatccatgtccctgcaaaagacattatctcattcctttctatggttgcatattattccatggtgtgtatataccacattttcgttatccagtctgtaattgatgggcatttgggttggttctatgtctttgctattgtgaatagtgctgcaataaacatacatgtgcatgtatctttataacggaatgatttatattcctttgggtatatacctagtaatgggactgctgggtcaaatggtatttctggttgtagatctttgaggaattggcacactgtcttccacaacagttgaactaatttacattcccaccaagagtgtgaaagcattcctgtttctccacagcctcaccagcatctattgtttgttgctttttaataatcaccattctgactggcatgagatggtacctcattgtggttttgattttcatttctctaatgatcagtgatgttgagctttaattcatatgtttgttggctgcataaatgtcgtattttgggaagtgtctgttcatgtcctttgcccactttttaatggggttgcttttttcttgtaaatttctttaagttccttgtagattctggatattagacctttgtcagatgggtagattgcaaaaatttgcccccattctgtaggttgcctgtttgctttgatgatagtttcctttgctgtgcagaagctctgtagtttaattagattccatttgtcaattttggcttttgttgctattgcttttggcatgttcatcatgaagtctttgcccatgcctctgtcttgaatggtattgcctaggtttttatccaaggtttttatggttttgggtttacatttaagtatttaacccatcttgagttaatttttgtataaagtataaggaaggggtcaagtttcagttttctgcctatagctagccagttttcccagcatcatttattaaatacggaatcctttccccattgcttgcttttgtctggtttgttaaagatcagatggttgtagatatgtggtgttgtttctgaggtctctgtcctgttcccttggtctatatgtctgttttggtaccagtaccatgctgttttggctactgtaggcttgtagtatagtttgaagtcaggtagcatgatgcctccagctttgttctttttgctcaggattgtcttggctatatgggctttttttggttccatatgaaatttaaagtagtttttttctaattctgtgaagaatgtcaatagtattttgacgggaatagcattgaatctataaaatactttgagcagtatggccattttcatgctattgattcttcctatccatgaggatggaatgtatacttgtttgagttgtctcttatttcagtatggtgaatattctattgaccaagtggatgaaacaggataaatcttgattatctgatgccacttcccatcccatctttgttctaataatcttctgcactttgaaaatcactgaactcattgatccaggtagtaaatagcataaacttcaatgtttggtcctaagtgctctaaatctgaacagaatatacttcattgttttcaagcaagtataaaaaaacagaatcctaaatacagatgtattcaattaatataatatcatttctgtagtgtttgtgttgctttagagacaacaaaaaaatatattaatattggactgattagttaaataaagctttataaatatatgagacttaacaaaattcaaacttgaccagatggaatgagctacgttgggaggtggtatatatcctacaacttgaggctttccagcagatgacagaatcccttttagcagagtgacaataaacaattaaaaactaaggagagccactactctatattgcctttaaaattacctttaatgctgattctgtaatattttcaaacttggccctctgggaagattaactcaaaaacatcagtttttaatttttttttttttttttttttttttttgagacagagtctcactcagtcgcccaggctggagggcagtggcttaatctcagctcactgcaggttccgcctcccgagttcacgccattctcctgcctcggcctccccagtagctgggactacaggcacctgccactatgctcggctaatttttttgtatttttagtagagacagggtttcaccgtgttagccaggaaggtctcgatctcctgacctcgtgatccgcccgtctcagcctcccaaagtactgggattacaggcgtgagccaccgtgcccggcctccgtttttaaattattattgtatcataagaagaaccacataaccttaaatttataatactgaccactcttaagtgtagagttcaatagtgttaagtatattacattgctgtgaaacacatacctagatgagtttttcatcttgaaaaactgaaactatataaccaataaacattaattccccctccctcatctctccagccctaggcaactacctctctactttgtttttatcagtctgcctactttagatacttcataggagtggaatcatacagtgtttgtccttttgtgactggcttattttgcttagcataatgccctcaaggtccattcatgttagcatatgataggatttccttttgttcctaaggctacatagtgtgtgtgtgtgtgtgtgtgtgtgtgtgtgtgtgtgtgtgtgtgtgtgtgtaacattttctttatccattcttctgttaacggacatttgggttgcttccaccacttgagtattgcaaataaggctgtgatgaccatggctgtgtaaatatttcttcaagatcctgctttgaattcttttggatatttacccagaggtggaattgctggatcgtacggtatttctatttttaaagttttcaagaatctttatactgttttccataatggtggcaccattcccaccaatagcatacaagcatttcaatttctccacatctttatcaacacattattttctgttattttgacagcaggcatcctaatgggtgtgaaatgatttttaattgtggttttgattggcatttccctcatgattagtgggttgaacatttttcatagatgtattggccatttgtatattttctttggagaattttctattcaagtcttttgtccatttttagttgtgttacttgttatttgttgttgagttgtagaagttcttcatatattctggatataaagctttcacatatatatgatttgcaaatacttcctccagttccattggttgtcttttcactctggtcattgttttctttgatgtacagaagtctttaagtttgatgcagtacaatttgtttttttttttttgctttcagtttcctgtgcttctggtgtcatattcaagaaattgttgccaaatccaatgtgtcctgacatttttctattagttttatagtttaaatattacattttctgtaggcattatagagtttaaagtcttacttatatctttaatccatctcgagttaatttttgtatatggtataaagtaagggcccaactttatcttttgcatgtagatatccagttttcccaccaccatttgttaaataaactatcctttccccagtggtagtcctagctcccttatttaaaataatttgccatacatgcaagggtctatttctgggatctacattctctttcactgatgaatatatctgtctttatgccagtaccacaccatcttgattactgttgctttgtagtaagctttgaaatcaggatgtctgaggtttctaagtttgttcttattctccaaaattgattaggctatttagtgtctcggaactaacgcttttaaaataaggatcatgggaagcatttaatgtaaacatatagagacaaagggattctcattctgctctcattccataaaacaaacaaacataaaaacattctttcccacagctgagtggcattcagaaaaagaagctcccttctaaatatcagaaagaacagttaccagaaaaatagagctgagctacaaaattcttgttaattagaaggtgcagctatttaacagagtataaatatacactatagcctaaaaataattaagagcaatgctgaaattctctaaagtacatgatcattctatcaaaatatactaaatgtattataatagaaagaactcataagttatttatttattaattttttttttttttgagatggagtctttccctgtcacccatgctggagtgcagtggcgctatctcagctcactacaacctccacctcccaggttcaagtgattctcctgcctcagcctcccaagtagctgggattacaggcacacaccaccacacttggctaatttttgtatttagtagagatggggtttcaccatgttggccaggctggtctcaaactcgtggcctcaagtgatccacccaccttggcctcccaaagtgctgggattacaccttggcctcccaaagtgctgggatcaccaccttggcctcccaaagtgcatgggctaccgcacccagctccacaaattattaatatctaatcagtctctcactttagattagggtttagattaggaaactgaggcatacagctagtctaagtgacttgcccaagaacattcaaatagtaagtgtataaagacaataatctaacatctgtttccagttatgacttactcttacacgattcttccttctcagtctgatatgtgtcctacagtcaaatgtgtttctaccttgttacctctctgttcttactgaaagaaacctaactttctgccccacccattgtggtacttgcatggtatttacttagtctcttaatcaaccagttttaattcataagattgtctttttcagcagaaaacagagtctagccaaagtatcaaacaactaaaacagtatctaaaacaaaatattcctgaaggcatttagtgctctactcatttctccaattgcatgcaacatctagagcatttacctatcaatcctttcatatataactatcccatttcatcctctttatattactatagtatagtaacaataggtataatctcattttatctcatttcaggcacaataaaaagtcatttaatgtgcctgaggtcacatgactaatttgtgatagagccaagatacaaatcctggtctctgactttggatcttttgttcattccattctatcacactgtcctacttttgatattacacttggttctcaacaaatatgccccatctcctctaaaggtattttcttagttgttcccataattgaattagtcaactctatctatccattagtcagctttcctctaaataaccccatttttgtgctgataccacctaactctcaatttacttagtcaccaagtcctgtcaattatttctttaagattcatcatttctctataagctgattacaattttcattgtttctcactaggactctggaatatcaaatctccaagctttatgctttgcatattaggtttatttaaacacagaagatatccctaaaaaatactcccaattattttaaattgttcaaaggaaataataggaataaaataaagaaagaaaccatattaaatatgaagtatttattcctcattaaaggtctaaagttttcattaatatctttttattttccaaatgttaataaaaatatcaactcaataaaataaatgcaaaacttgcaatttatttcaatagcatgaatatctactatttgccaagcagtactaagcatgttcatattgaggatcacattaaaatttcaaaagtaccctaaaagatgaggaaatggaagcttttagcatttaagcagcataagctagcaatatgctctccaattatgaaaacaagtttctctaatatatttttcagcatttatttaatttagctgcctggaaggttggcatatttgtatcccacttaggactaatgacttcattttcaggaagcaaaaatacaaatatccttgcgaacagccaggaagtacaaaaatgtgttttctaagtattcatgagcccatcatggatgcccaccctccctctcttcttttggagaaaaaaaaaaaaaaaaaaaaaaaaaacagtctcattgccaaattagataacttcctttcctggaagcacatttagtattttattactgtctcaaatagttaacatcttctaggttaaatgaaagtatttttcaagagaggaaaagtgaaatagcttacaaaatgactgtgtgataaccagcacttgaagactacgtactaaaacacagaacccaaaataaaacacacacaactactcaacgtgatacacattcagtgtcagctcagaagcctgagaacccaatatgctgaccaggccaaagctagaaattaggttacacattttcttttctttctttaacactactagcactatccacaaagaacaagacaagtcttacccatgaagcctagtaagaaaagaaaacagtataacacttacagttgtcgtctcatcagtttcattttcaaaactctgattttctttattttgctcaatacatgaagcattttcctttgatccactgcaatctgtaagctaaaataaaagtttaaaaaatcaatactccttttttattttctgcaatgtatattgttttcaaactttgaatatacacattaaaatatctaaggcctgaataaatattagatgttgcttatttcaattttagcatatgaatgtactatctaacccatttttatattgctcccaaagagaaaacataaaatgggacagttattcaaaggccaattttaaatttcaaaggtttccagcagggagtgttgaacatgggctattcaaaagtaaatggatgatctggttaaagctgagcatggttaatgggaagatgaagatagagggctgatttcactttatataagttctcatgcttggagaaatctctatggaagctattggagctctcagaactagcagtggcattgactgcctttgctttgggctgtctttttataactacagctttagatgataaaaataatgtctactttcaaagcaaagggtaggtttgcttactgaccattataaaacagatgttacctaaactgagggaacacaacctacaatatgacccattgaatatgactgtatcatgtgaccatctttgccttgcactgtaaaaattggggcttgagaaattggtacaagaagatgttgatagtctactgctgttgttgcaagtaattagtctctgccctacgattcttttggcagcatcgatgaaattgtggcagactaaattcttagtttgcaagtaggatacaatcttagactcctcacagttcttgagagtgacaaggatggaattctgacagattcatagtgttctggaagaggaaggatcagagacttctaggctgatgaaagggattcgtggaacatctttaggaactgggtagtaaacatgctgaccacactgaatgttcaactgcataataaggattcctcactttaggccaggcacaatgtctcacacctgtaatctcagtactttagaaggccaaggaggatggatcacctgaggtcaggagtttgagaccagcctggccaacgtggtgaaaccctatctctactaaaaatataaaaattagccaggtgtggtggcatgcgcctgtaatcccagctacttgagaggctgaggcaggagagtcacttgaaccagggaggtgcaggttgcagtgagccactgtgctccagcctgggtgactgagcaagactctgtatcaaaaaaaaaaaaaaaaaatcccctcactttaatgcacgttaatgaggagaaatttctaaagtggttgcaggctaggacagctcccaaatggtttttgccaactctcctctggctgggagaacttcctcaccaacctagcagtcggcctcagtttctaagattcactctaaaaggagtgggtgaacagaaatttccactccttttcaggcaatagctatagagacatgtacctgcactgattgtgacaggagagaaatttgcaaccactgtgggcagaaggatttctctgatactagtctattgtagactctcctcttctctgctcccgtagtttacatctatcattgtaattagcatattgtattataaattacataaatgtatatgtatatatatgtgtgtgtgtgtctacatgtatgtgtttatgtatgtttatctgtcccattagagtatcttgtaagacaagcaggatatcttactgtttttcagtctctagaataaatacatatttgtttgatgaatgaaaaataaagattaaattagatgaaaagttgatacatagatagatgaacaaactgagaagatgtgtcatctcatgaagagcagtttcaggctcaaccactttgggatacccaggtagcctctgtatcagaaacatagagctctttattttgtgctcccctctttgggccactcctctttggtcccatgaactatccaaataaatcagggcagtcaatctgactgtatctctcatgtagatgtacatagtaaggacctgtcctctgatgagacccactggaatcaagatgctgattgagcctgcactgtcaccattgctaattggatccatcatcatactgaacacggcggcacatccaccatcatagactaagcgcaaagtaaaagactgcttcccaggcaaaggctacctggttgtcctaaggtgattgagctcggcatttctcttagccagatcagagcccttattcattgtttgtacatttgttcatctatctatgcatctctttgtgatggttaatactgagtgtcaacttgattggactgaaggatgtaaagtattgttcctgaatatgtctgtgaggttgttgccaaaaagattaacatttgagtgagtgggatgggaaaggcagacttatccttaatctgggtgggcaccatctaatcagctgccagtgcagctaggatataaagcaggcagaaaaacacgaaaagattagactggcctagcctcccagcctacatccttctcccatgctggatgcttcctgcccttgaacattggactccaagttcttcagttttgggactcagactggctttccttgctcctcagcttgcagatggccattgtgggaccttgtgatcatatcagttaatacttaataagcacatatatatatatgtgattctagagggacagaatattaaggatgaagtcctttcattggtttgggggtttctggagttggctgcttaacatgattcgacccaaaaatgctaaaggctctacttctagtagtatggagaacactgatagtccttggcatgaactgtttagagagttatgcaagatgaatgcatttgacattcctgattcaccattcgtgagaggcaaggagtttagcgactctatacataatacatttgactatatgtggagaatcaaggaatataatgaagctggttggttgctcctgagttcagtggacaaagtgatgaaaggaaatgatgaaatcagggattctaaataccagcttcagaagcagatacggagcctcaaatctgctaagattaccctgagtgaaagtcttatctcctgtagagaaagatatgaaattgtgggaaaacagacacaagcccttaaagtgagggcactgattggaaaagaatgggaccctgcaacttggaatggcaatgtttgggaggtctctcatgaagctgggaacactgagtttgtaaactctgacgaagctttttttgccagaagaaacagctcccccattcccagtagtggcaacatcccctccccgacccattagcctttccaccgttgtctgaggagataaaccccgcactgcctgagaaaacagtgacaccctcccctgaggcagttgccaggcaagataatgttgattctcctcaggagccacccccaacagccctgtttgcttctagacttataactaggctgacctctcagtgggccctagaggtgaagttcagagtgtgacctataaggaggtacactatactcaaaaagaactacttgaattttctaatttatataaacagaaatctgaagaacaggcatgggaatggatattaagggtgtgcgataatggtggaaggaacatagaactggatcaggctgaatttattgatccggccccactaagtagggactctgcatttaatgttgcagctcgagtgaaaaaaaaggttgtaataatttgtttgtttagctgaaatatggattaaaagataacccactgtgagtgagctggaaatgcctgatctcctttggtttaatgtagaggaagggatccaaaggcttagggagattgggatggtggagtggattagtcactttagatctactcatcccagctgggaggtccagacgatacattcttgaccaatgccttacaaaatagatttgtgagggcagcacctgcatctttgaagggccctgtaattgttctactctgtatgtcagatctaagagtgggaactgcagtcactcaactaaaaaaaatttaaatacagtgtgaataatgggatcccgaggtggcaggggccaagcggtagcactcaacctccaaaggcaaggtaagcatagctaccataatggacagcagaggcaaaatggcaatcagaatagtctgactcgtgtagagctctggcactggctaattaatcatagtgtttctagaagtgaaattgataggaagcctactgcattcatacttaatgtatacaagcagaaaacttctaggtcaaatggacaaaagactaatttgaattataaaaacagaatcatggcccctcaatcaatttccacacttgagtcagtttacagacccagaaccccttgaatgaaggggagaccaggtccccttgaggaaggaccctactacactaccaacaatttatactgttaatttttctctctccttccccaaggagacctccagtcttttaccagggtatctgtgcactggggaaaggaaaatgttcagacagttcagggattactggacactggctctgaactgacatcgatttcaggggacccaaaaggtcattgtggtcctccagttaaagtaggggcttatagagatcaggtaattcatggagctttagcttggatctgacttacagtgtatccggactcatcctgtggtcatttctgcagtgccagaatgcataattggcatagacatacttgcaagctggcagaacctccacattggctccatgactggtagagtgagggctattatggtgggaatgccaaatggaaaccattagatctccctctacctagaaaaacagtaaatcaaaaacaatattgcatccctggagggattgtggagattagtgccaacaccaaggacttgaaagatgcaggggtggcaattcccactacatccccattcaactctcctatttggcctgtgcagaagacagttggatcttggagaaggacagtggattatcataagcttaaccaagtggtgactccaattgcagctgctgtaccagatatggtatcattgcttgagcaaattaactcctggtacctgctatgcagccattggcttggcaaatgactttttctccattcctgttcataagacccatcagaaacaatttgccttcagccagcaaggtcaacaatagacctttactgtcctacctcaggggtatatcaactctccagctctgtgtcataatcttatttggagagaacttgatagctttttgcttccacaagataccacaatggcccattacattgatgacattatgctgattggatccagtgagcaagaagtagcaaacacactggacttattggtgagacatttgcatgccagaggatgggaaataaatccaactaaaattcaaagaacttctacctcagtaaaattcttaggtgtccagtggtgtggggcctgtcaagatattccttctaaggtaaaaaataagttgctgaatttggcccctcctacaaccaagaaggaggcacaatgcctagtgggtgtacttggattttggaagcaacacattcctcatttaggtgcgttactcccgcccatttattgagtgactgccggttttgagtgtgttccagaacaggagaaggctctgcaacaggtccaggctgctgtacaagctgctctgccatttgcgccatatgacccagcagatccaatggtgcttgagatgtcaggggcagatagggatgctgtttggagccttcggcaggcccccataggtgaatcacagcagaggcttctaggattttggagcaaggttctgccatcttctgcagataagtactctccttttgagaaacagctcttggcctgttattgggctttagtggaaactgaacgtttgactataggtcatcaagttgccatgagacctgaactgcctatcatgaactaaatgctttctgacccatctagtcacagagtgggtcatgcacagcagcattccatcagcaaatggaagtggtatatacatgattgagctcaaggatgtcttgacggcacaagtaagttacatgaggaagtggctcaaatgcccatggtgtccactcctgccaccctgccttctctcccccagcctgcaccaatggcctcatggggagttccctatgatcagttgacagaggaaaagactagggcctggttcacagatggttctgcacaattatgcaggcaccatacccctgcatactacagctgcagcactacaacccctttctaggacatcgctgaaggtcagagtgaagggaaatcttcccagtgcacagaagttcaagcagtgtacctcgttccacactttgcatggaaggagaaatgaccagatgtgtgattatatgctgattcatgggctgtagccaatggtttggctagatggtcagggacttggaagaagcatgactggaaaattggtgacaaagaaatctggggaaggggtatgtggatggatatctgagtggtcaaaaaccgtgaagatatttgtatcgcatgggattgctctccaatgagtgacctcagcaaaggaggattttaataattaagtggataggatgacctgttctgtggacatcactcagcctcttttcacagccacctgtcattggccagtgggcccatgaacaaagtggccatggtggtagggttggaggttatacatgggctcagcaacatgcagttccactcaccaaggctgagctgcctggttatggccactgctgagtgtccaatttgccagcagcagagaccaacaccgagccctcgatatggcaccattcctcaggatgatcagccagctacctggtgtcaggttgattatattggacctcttccatcatggaaaaggcagaggtttatcctcactggaatagacagttactccggatatgggtttgcctatcctgcacgtaattcttctgccaagactaccctgtggactcacggaatgccttaaccacagtcatggtattccatatagcattgcctctgaccaaggcactcactttacagctaaagaactgtgattgtgggctcatgctcatgctcactggtcttaccatgttccccatcatcctgaaacagctggattgacagaacggtggaatatccttttgaagtcacaattacaacaccaacaaggtgacaatactttgcagggcttggccaaagttctcaagaaggctttgtatgctctgaatcagcatccaatgtatgctactatttctcccatagccaggattcacaggtccaggaatcaaggggtggaagtggaagtggcaccattcaccatgacccctcgtgatccactagcaaaatttttgcccctgttcctgcaacattacgttctgctggcctagaggtcttagttgaagagtgacaaactctgccaccaggagacacaatgattccattaacctggaattgccacctggacactttgggctcctcccacttttaagtcaacaggctaagaagggagttatagtgttggctggtgtgactgacccggactatcaagatgaaatcagtgtactactccacaacgggaagtaaggaagtgtgtgcgtggaatacaggagatccattagggcctctcttagtattaccatgccctgtgattaaggtcaatgggaaatgacaacagcccaatccaggaaggactacaaatggctcagacccttcaggaatgaaggtttgggtgactccaccaggaaaaacaaaaacaaaacaaaacaaaaaagcaaaacaaaaacacacaacctgctgaggtgcttgctgaaggcaaagggaatacagaatggttagtagaagaaggtagtcatcaataccagctgcaagaatgaggactgtaattgtcatgagtattccctcctacttttgttaaaaacatgtgtaagcatatatacgcttgtattaagaaaatatcttcattttatttcctttttcctttattatgtgacataaaatttattgacttcatatcagcattaaagtattgttaactttatgtagtagtatttgggttggggattggtgcatttccagttgtacaaacaatagttgtattatgttagatgtaattatggccttattattgtctttatttgaagattatgtatgatctcaggagatgtacgtgggttcaagttgacaaggggtggacttgtgatggttaatactgagtgtcaacttaattggattgaagaattcaaagtattgatcctgggtgtgtctgtgaggttgttgccaaaggagatgaacatttgagtcagtgggctgggaaaggcagacccacccttaatctggataggcaccatctaataactgccagcacagctagaatataaagcaggcaaaacaacgtgaaaagactagactggcctagtttcccagcctacatccttctcccatgctggaagcttcctaccctcagacatcagactagaagttcttcagttttgggactctgactggctttcctgtagacaacctattgtgggaccttgtgattgtgtgagttaatacttaataaactcccctttatatatattacacacacacacacacagacacacacacacacacacactattagttctgtccctctagagaaccctaatacactatctgatttaatcttttatttttttcattcattaagcaactatcttttgatctctggagacaaaatgacattaatatggactgcctgtcctctgaagaactctaattggccagagaaatataaaaatacgtaatttatattacatatatagatcatgataatagaaagtataggaggagcatctatattagactgtggaatcatgaaggcttcctgaaagatgtaacattgaaataatactgaagacaaaggaggttatctaggcaagtaggagtattcaatctaatagaaaatagtgtgggcttgaaaggcagcatgctctgaaggaaaaggcatagattttagagtaagaaagaaatggattaaaatcctttcacttccacctactacctatgtggaatggaggcaatatttaaattctatgactatcatcattgaaaatatggagatagtgccacccattgaatagggtcttcttccaccttactaaccaccctatagctgagttggatgccttggattgtaggggagaaaaaaatagctttcctctaccctcctacattctttggctgagctacaaattaaattgacataaggcagcttaactggagagacattattctaataacatgtgtacccatgtatgcatgggagtctcacaaaaatatgaaactcaaataagggacagaattcccttattccccagattgaagcttatttagcattctgagctacagaaagaaataagggcttggggtttctggggctggtgaagccaaattatagaaaggtgaggggaagaaatgtatagtgaataaaggttgccttgttatgcagatcaaagtctctcatctgataaaagttgtcatagactaactctctttctgacacaaatatctttactaatgaaaatctcctatataaatataaatttcctacataaaaggggagtttttcaatgctacttcagtgtctgtagtttcacaaaataaccagctttaaaaaaatcagtatgccacagaggaatatttggggctggtactctggtctcctatagtcatatttttgggtggcataccctgggccccagtgagatttacaaccttcctacctcataccagatgttgtcccatatatacatacatacaaagcactcagtctcaatatcatgactgattctctatttgtttatgtttccaccgttacttcatcccctgataacttgctgtcaattatgctctcatagaaatagtaaatttcttctatgcttctattcttccttcatttaaaaaaagaccctgatcacttcaaaactttaatctatttctgactttctcctccccagagtcaattctgttgaaagacataatagaagtagtaatagcaacaataaaaccgaatcatttaatgaaaagttacaataagctaggcctctcttcaaggatactgatatatattttatgtgcattaactcattagattaaaaagcatcttatgaagtaggcttatgatctttattttctgggtaagaaaacagaacctatttctgcctgaatgaaaagcctacataactaactaatatactaaactcctgagccactttcttactgcccacacatcctttcaaattgtggttcccagaccagcagcatcagcaccacccacaatgtcttagcaagatcaactcttcaacctactgaatcaaaccagtaggggtggggctctaaagtctgtgcttcgatgagctctccaggtgattctgacacatgctagtttgaaaacctctgatctagttaacaaatgttaaactattccaagttagcaaggtataagacacatttacgaagagatagatgattctcggcacaatggaaaattaatgcctgtctaacaagtgcagtctctagtcacttccaaacatttgttgccagatgtttaaaactatcaagagaacttagaagtctgaatttttatgtgaaatagcttgacttctaaatgttgacaacataaaaaaagaggttatgggaggccattgttttggactgagttccttcactaggccccaaaagaccagacgaaatcagaatggagtcattcatgctaggtatcacataatcaaactgacctttaaaatgggacagttttctaaagaacaagagattcacagcaacccattagaagaggccccatggccccatctaagtaaactgacctgataagaatgtctcctctgttttaactctataaggaaagtactttgaaatgaccagtctgctttttattccttagttctgcttctttcagctcctttctgcctgtaaggtcaataggctctgctcagctcatcagaacacctttctacttcatagatggaatgcttcctgatttcaacaaatttaatttaatgatcaaactggttttcaggaaattttgttctttgacagcaactatatatttttaaaatatcatctaagctaacatgcaataggccaaacaaaatataaacctgcactgcagtttccataagggcagccagtttgcaacctctgtattaatcctcaaatgctgccttctcttccctgaatactgaactcttaaaactcaccaagaacctcctagtcctcactgtcttcctagttctgtccaaatgaaaagcctgtgcagctaactactacactaaactcctgaaccacatctttactgcccactcatcctttcaaattgtggtccccagaccagcagcatcagcgccacccagagatttgttagaatctttttctgactttctatactcctcattatcttccactttctctgacatttcacacgattgacctcttcctccttcttgaaagttatacctatattcagaaacatctctctctcctatttgccacccaatctcttgaactctccttctctgtcatttcctcttcttccttttaactcctgaatcagctgttactctgaaattccttttatcgcttctctcactactcactactcaatgattcttcatctaggctttaggaagacattcttcccaatttctggtcctacattttcaattgcatgcttgtatttcctctaaaaaatcacactggtacctcaaatctgttctatctaaatgcaatcatttttttttcagaacccaatttggctacctggcttttggtaattccactacccaaatttcttaagaactatttatgactccctcctccacacagcctgtgctgatcctctttctttatccagctggatgggctctctcaatctataatgccttcaggaaatattcttctcctctacacctttaataatgattagtccacctgatctctttaggaacaacctagaatataaaaaaaaaggaaaaataaacttgtcattgcttatatatttatcttctccattcaagcagatttaaagcttcttcaacacagtaagtttattaccatcttgacatccttcatagtactttaacaaagtgaatgcccatagatattaagttgtttaattatgcagtgtttatacaagtattttctacattacacaatatgtatggacaaatatttgccaactttactttaaatgtattcatcttttatatacatatccgaaaagtttcctatataaaagaatattataataaacttagaaaaatctagatctcttttgtagagtaaataagtactcagtggtttaactgtttggtagattacttttttatttatttatattattttgctcaaacctagaattcttttctttggaaatgaatgtcagtactaatgagcatcatgtacaaaatctgtgtccttgcaggaaccaaaagccatataaactctaaaaatatatgttaaaaaagttaaacagagttctacgatgccaggtcactgggaagcactgccccttcccatcctctaagaatgtcaagtgtacagatcagcctgagtcagatcccagttgtactctggagtaatccaattctattaatatttcctgggtctcatatttatagaatgcctagtttacttaactctatactattctcttcatacaaaagaaatgttacaaactacagaggtatgaggtgaggaggagtctttaggtggggttcagaacatgctaccccaaaatagggcaatgtagcatttgagaaaacagcagaatcaggaagttcactctcactttcccgtcaccctgaagcaagtgataaaaccttcattccagaggaaccctcctaatacccagagggaaagaacatccttgtgctcaaagacacaaagaagacaagaagaacctgaacaaacaggccttaagtctgcctagtttattaccattagatcatatctcttttgccagtcatacttctgcatggctgcccactcttcatcaaattcagcataaaaatacacaggtttccctttttctttaggtcttcacttctctgtcatgtaaaacttatgttaaattaatgcatatgcttttctcttgttaatctgtcttttattataggggtcttagccatggacctagcaatggataaggaaaagatattacttttttcccctacacttttattttacagaaaacagcatgctaccattttatagactacttcaggattacaaacaatgggtaagtttaaactaagtagttctcctctgctgaaataataataaacttcactctcttagcctaaaggcctcaggattccttgaaaaaactgggcacagacaaataaaactaggcacaacctaggagttcaagagaagagagtatcagttatcaagaaaagtgtccaccttatttgttgattcaatatacatgtattaaattgtattacatgcaaagcactaaagaagatgttttggggaaaacacaaagaagacagtgtccaaaaagaatttagtgtaagaaaggaaacaaatatatacaaaagtcactataaaaccatgtggaaagatttgattgtcaaaaatgaagtgcagacaacatgctctgaaacttcaacagaggttcagttcaataaacatttattaaatgctcaatatgccagtcctttaagaaatgtagagtgaaataagtgaaacaagtatataagcagataatttcaatttaattttgaagtattataacagaatgatatagttggacaactacatttttgccatcaaatagttgttagaaatgaaatagaaaaggtaagcagaagccaatttaggagaatcttagacattatgccaaagaattcagattatcccaaaaaatagggaatcaaagaagggttgaggtgagaaatgatagggaagagtagaggggtcaaatgggaaaacattttaaaagtaaagctctcacagacttatttattattttacatttttctttgatttttaaatgtattcaaaataacttaaagcttataaaaattttgcagaaataggacaaaaaatatcatgtacctttcacatgcatttccagctatatagttgtttatggtagctggtcttatctagtaccaggtacttcattatgtcaatgtcttcgtcattgcaaacctttaaaaagtctggctgactactatgcaggtatgcaaataataaaaaaggtttctataaactaacagaatttttttcaggatacactgttaaagtaaaacaagcaaagtgctaaagaacacggtcatcccctcagtacccatgtggagttggttccagaaaccttcacagataccaaaatttgtgtatgctcaagtccctcatataaagtgaagtagtatttgcatataacctacacatatcctcccagatacttttaaacatctctagattacttataataccaaatacaatgggaacgctataaaaatagttgttgtactgtatttttatttgtattattttcattgccatactgttatttttattgtcttttaatattttcgatttcaggttgattgtatatgtggatgcagaacctgtggctaagagaagttcaactgtgtctataatatgctatcttccgtgtaagtgtaggggcaaaggaaattttccgctccctctctgaaggttccagtttgctaaaataaactgataacatgaaaaacggtacgtaaatgtattaacatgcaagtgtgcacatacaaactatgtatgagccatacaaaattgaaacacaaaaaaggatgagatggctaatgcttaaatagcaccctcttcatagaggacaaggagatgagggaatgtaggcaatttttaggggtagtaaatgatttttaggagagttgattgggcccaaagaacagatcatcatttgtgaattgctgtgtttggaaactgaatgggaccttaagaacagacaatagtttgtgacattctgtctagatatgtaatattcctcagtctttcttcctgaaatatgagtttactcctctctaaataataaaatttcagggaaggtatccaaagcaattatgttccttctggagtagcttcagataaagaaccttcagagagttcgaccctgtgcttgggaagagacacagaaggtcaaaaagtccttgattctgaggccttctaatttcctttaattcaagtgctaagcatgtcaaagagctatacttttgggtatcattttctaagccccaacataagaaagaagggaaaataaaaacacatacatgtatcttatttgtcctatggggggaaaagtttccccaagccacctaggattcctggctaagcctaaaaataggagaaaagcacataattttaattcaataaaagtttatatattacatggcagcgagccatcataaggaaatgaagatccaaagacccaaggaaaactgtattttaaaaaataaatctgataaaagcagtgcagagttgtgaagaaacatgactggacaaaaaggggtatgatctaatggtaatagactggagggacaggggagaggagaaggaacttcagtaaggcctgtttgttcagattttttcctgtgtctctgtatgacattctttccccccacatatacagcaggatacttgcctcgtaagaacctttagggtaaaagggaggccagagagtgacctttccaggtttcatgcttgctttggggaagaggaattctagtttctatgactcacccaaggggagagtaattctgctttctatgactcagcttgggcaggaaaaatagtggggaaaggtgaatagaagaaagtcaaagaaactctgagccccttacaatctccttcagttcaaagtactcagcatgacaaagtaccataatttgaggtatcatgttctgagcccaacactacaaaattcaagttaggaaggttaaataatgtcccaggttggcaactatctgaggctggtattgcacaggtggtaaaaagaatttaccaagacagctgtacgtaaagaaaggcaggtttgagaaagtaggaaaatgcattgcaagaaaacaacaggtaggtcagcaggagaggaggtgactgacaggagagagagacttgctggggattttataggatgatgtttgtgctgtgtgctgaagagggctttctctttttgctttcccttggtcccaccagcccaactccccttctctaattaggactccacaaataaggcataacaaataaaaaaaaaaaacaggggagaagggaaagctcttccttacaggaaaatgtcaacaaatacacgtagaagaaatgaggcaatcagaaaactaccaaccggaagacaccatagtaataattgtttggaaaagaaggtgatacacaaaatatttacctaaatgcaaaatatctcaaggggtgccagataagatagccaattagaagcagctgcagtctgcagctgtcacagggaggagtgaaaacaggaagcgaattctgtaccttcaactgaggtatccaggttattgcattaggactgactaggtagacagctggacccatggagagtgaggaaaagcagggtgaagcaatggcccacggagcagcacagagccaggggaacccccacctccagccaagggaggtggtgagtgattatgcaccctcatctgggaaaccatggtttccccatggatctttgcaaactgtagatcaggagatcccctcgtgagccaatgcgaccagggccttggatccgaagcagagagctgtgtggaaactccacataatggccactggggcatgcacagaggcccaagggttttgtataatctggccctgggaattccagtgaggtgggagatccatccacgcattacgctaggaagggggctgaatccaggagttaagtggcttcattctgtgggccctactcctacagcaccttacaggttaagacccactggcttggaattccagccagccagtggcagcaggctggagactgcctgaaacagaccaagttcctggggggaagggcagccaccatctctgaagttaagagtgggccattctaccctgccagctccagggagtccaggctgtctggactggaaggagttccccacaatacagcatagctgccatgccagatcatggccagactgctgctttaactgatccctccctcctcactgggtggggcctccctgtgggaattacagcaacttcagccaagtttttcagacagaactctgatctctccctaggatgaagccccagggggaagtggccactgtccctgtggttcagctggcttagatgttccagcctgctggcactgaagagtccgggcattctggacgagggggggttccgcccagtgcagcacacctgctttgctaaggggcagccatactgcttgtttaagtgggttcctgaatcccttcctccggactgggtgagtcctcccaataagggtctccagacgcctcctacaggagcgttctggccagcatcaggttggtgaccccctgaaatccattagctcccagaggaaggagaaggctaccctctttgctgtttcacagccttcactgatgatatctccaggtgctgaagggaacaaggtgaccagggtctagagtggacccccaggaaactgcagcagctctacagaagagtggcctgaatgttaaaagaaaaacaaacagaaagctacaacaacaacatcaacaagaaagaccccacaaaaaccccattcaaaggtcagcaacctcaaagattgaaggtagagaagcccacaaagatggaacagaatcaatgcaaaaatgctgaaaactcaaaaagccagagtgccttttctcctccaaatgactgcaatacctctcctgcaagggcacagaactgggctgaggttgagatggctgaattgacagaagtaggcttcagagagtggttaataatgaataacaaactttgctgagctaaaggagcatattctaacccaatgcaaagaaggtaagaatcatgatgaaacaatacaagacctgataaccagaacagctagtttagtgggaacataatagatctgatgaagctgaaaaacaacacaagaatgttacaatgcgaccacaagtatcaatagcagcatagaccaagcagaggaaagaatctcagagcttgaagacaatctttctgaaataagacaggcaaaaaaaatagagagtaaagaatgaaaatgaacaaaccaaacctctgagaaatataggattacgtaaagtgaccaaacctatgaatgattggggtacctgaaagagacaaggagaatggaactaagttggaaaacatacttcagaatatcatccaggagaacttccctaacctagcaaatcgggccaacattcaaattcaaaaaatccagggaaccccagtaagatacccaacaagaagataatccccaagatgcataatcgtcagattctcctaggttgaaatgaaagaaaaaaatggttaagagcagccagagagaaaggccaggtgactaacaaagagaagctcagcagactaacagcaaacctctaagcaaaaaccctacaaaccagaagagattggggccaatattcaacattcttaaagaaaagtatttccaacccagaatttcatgtctggccaaactaaactccataagtgaaggagaaataagattcttctcagacaagcaaatgctgatgtaatttatcaccatcaggcctgccttgcaagagttcctgaaggaagcactaaatatggaaaggaaaaacccattaccagcaacaactacaaaaacacactgaagtacacagaccagtgccactatgaagtaaccacataaacaagtctgctaagtaaccagctagcatcatgataacaggatcaaattcacacataacaatagtaaccttaaaaataaatgggctaaatgttccaattagaagacagaatggcaagctggatagagtcaagacccattggcgtgctgtctttaagagacccatctcatgtgtaaagacacacataggctcaaaataaagggatggaggaaaatttaccaagcaaatggaaaacagaaaaaagggggttgcaatcctagtttatgataaaacagactttaaaccaacaaagatcaaaaaagataaagaagggcgttacacaagggtaaagggttcaattcaacaaaaacagctaagtatcctgaatatacatggaccaaatataggagcacccaaattcatgaagaaagttcctagagaactaaaagagacttagactctcaaagaataatagtgggagacttaaacaccctactgtcaatgttagacagatcaccaagacagaaaattaacaaaaatattcaggacctgaactcagctctggatcaagtggacctgataggtatctacagaactctccaaccaaaaacaacagaatatatattcttctcataaccacacggcagttactccaaaattgatcacataaatggaagtaaaacacccttcagtaaatgcctaagaggcgaaataataacaaacagcctttcataccaaagcacactcaaattagagctcaagattaagaaacttatttaaaaccacacgactacatggaaattgaacaacctgctcctgaatgacactttggtcaaaaatgaaattaaggtagaaatcaagaagttctttgaaacaaatgaaaacaataaagtatcagaatctctgggaaacaactaaagcagtgttaaaagggaaatttacagcactaaatgccacattaaaaagctagaaagatctcaaattaacaacctaacatcacaactagaagatctagagaaccaagagaaaatgaaccccaaagttagcagaagacaagaaataaccaagatcagagtggaactaaggagacagagacatgaaaaacccttcaaaaaagtcaataaatccaggagctgattttttgaaactattaataaaatagatagacactagctatactaataaagaagataagagagggcagtaaaatagacacactcagaaatgataagggggatatcaccgctgaccccatagaaatacaaacaaccaagagaaaactataataaacacctctatgcacatcaactagaaaatctagaagaaattgataaattcctggacacatacattctcccaagacagaaccagggcaaaaattaaagccctgaatagaccaataacaagttctgaaattgaggaaggaataaatagcctagcaaccaaaaaaagcccaggaccagataaatttacagctgaattctaccagaggtacaaagaaaatctggtaccatttctaatgaaactattccaaacaaatgaaaggaaagactcctccctaacacattttatgaggctagcatcatcctaatgccaaaacctgatggagatacaacaaaaaaagaaaacttcaggccaatattcctgatgaacatcgatgcaaaaatcctcaataaaatactggcaaactgaatacagcaacacatcaaaaagcttatctaccatgacccgacagttggcttcatccctaggatgcaaggttggttcaacatatgcaaatcaataaatgtgattcatcacataaacagaactaaagaaaccacgtgattttctcaatagacaccaaaaaagtcttcaataacattcaacatccttttatgttaaaaactctgtataaactagatattaaaggaacatacctcaacataagagcaatacatgacaaacccccagccaatatcacactgaatgggcaaaagctggaagcagaacccttgaaaactggcacaagacaaggatgccctctctcaccactcctattcaatgtaatattagaagttctggccagggcaaacaggcaacagaaggaaataaagaataatcaaataggaagagagaaagtcaaattatctttctttgcagatgacataattctatatctagaaaactctgccgtcaccacccaaaagtatcttaagctgataagcaacttcagcaaagtcccagcatacaaaatcaatacgcaaaaatcactagcattcctatacactaacaataggcaagcagagagccaaatcatgaatgaattcccattcacaattgtcacaaagggaataaaatacttaggaatatagctaacaaatgaagtgaagagcttcttcaaggagaactgtaaatcactgctcaaggaaatcagagaggacaaaaacaaatgaaaaaacattccatgctcatggagaggaagaatcaatatcgtgaaaatggccatactgcccaaagtaacttatagattcaatgctattcccattaaactactattgacattcttcacagaattagaagtaactgttttaaaattcatgtggaaccaaaaaggagcctggataaccaacacaatcctacgcaaaaagaacaaagctggagacatcagactacctgacttcaaactatactacagggctacaacaaccaaaacagcatggtacctgtaaaaaagaagacacctagagcaatggaacagaatagagaactcagaaataagacggcacatctgcaaccatctgaccttcgacaaacctgataaaaacaagcaatggggaaaggtttccctatttaacaaatggtgctaggagaactggctagccaaatgtgaaaaattgaaactggaccatttccttacacaatatacaaatttaactcaagatggattaatgatctaaatataaaactcaaaactatgaaaaccctagaagaaaatctagatagtaccatttaggacataggcactggcaaagatttcataataaaaatgccaaaagcaattgcaacaaaagcaaaaattgacaaatgggatctaatttaactaaacagcctctgtgcaacaaaagaaactatcatcagagtgaacagacaacctacaaatgggagaaaatttttgcaaactatccatctgacgaaggtctaatatctagagtttacatggaatttaaacaaatttacaagaaaaaacaactcaattaaaaagtaggcaaaggacatgagcagacacttctcaaaagaaggcattcatgcagccaacaaatatatgaaaaaaagcccaacatcactgatcattaaagaaatgagaatcaaaaccacaatgatataccatttcatgccagtcagaatggcgattattaaagtcaagaaacaacagatgctggcttggttgtggagaaaaagggatactttacactgtgggtgggagtataaaattgttcaaccattgtggaagacagtgcagcaattcctcaaagatctagaagcataaatgccatttgacccagcaatcccattactgagtatatacccaaaggaatataaatcattctattatagagataacatgcacatgtatgttcactgcagcactattcacaatagcaaagacatggaaacagccgaaatactgctccatgatagactgaataaagaaaatgtggtgtgtatgtatatgtatttatatatatatatatatacatatacacacacacacacacacacacatacatacataccagggaatactatgcagccataaaaagaaacaagatcatgtcctttgcagggacatgggtagagttggaatctgttatcctcagcaaactaacacaggaacagaaaaccaaataccacatgttctcacttataagtgggagctgaatgatgagaacacatggacacatgcaggggaacaacacacactggggccttacagtgggtggcagagtgagggagagcatcaggaagaaaagctaatggatgctgggcttgatacctaggtgatgggttgacctgtgcagcaaaccaccatggcacacttttacctatggaacaaacctacacatcctacatatataccccagaacttaaatgttgaagaaaagaaatagtgtctcttatgagattcttattaactactaaaagaaaatagtaactttacagtagataatctggaagctaccttaaccaagtgaacaatgcataatcagtaatttaacaaatatatattttaaataccttctcaaatcatgtaatgagaaggatatatcccttttgtagtacttctgccaaaaatatataacttgaatttaatcataaggaaatagcagaaaaaaaattaaaggctattttacaaaataaatgtcttatatttggggaaaaaaataaattcaaggtcttgaaagacaaaggtagactgagaaatattcttcattgaagatgactaaaaagacatgaaaactaaatgcaatgtataacactagatcagagcctggaccagcaaattttttttataataaagacatttagtggaacatttaatacaattttaataagatctataagaatagacaatatttagaccaatgctaaattcctaattttgatcattgtaccttggttatacaaaagaatatacttggttttagaaaatacacagtgaagtattcagggaaaaaaggcaaattgctctttaaccacacccccaaaaaagtatgcatgtgtttatgcctaaagagaataacacaaatatagtaaatgttaattttggagaatctgagtaaaagttatacaggttattttttactatttttgtaacttttctttgttttagattatttataaataaatagtttttaaaagaaagctacagatccaaaaatccaaactgtttgaagaaagtattatactaaaactatagcaaaattagtaatcagaatgtaaatatgtccaatatgaatataataaaaggaatgaaaaagatcttcaataaacagaatgctcagagatagaagaaaatacaaagtcaattttttaaaagccaaacaaattatgttggaaaacaggaagagagggaacaagaggtagaacaagacagatataacaaagagccattaaaaatggaataaaaaatagtcattgcaacaaaaattaatagatattataaaccatagactaaacatatgcagaaaaattggaagatagcacaagaaatcccctcagaacacaacactaaaatgctgagatctaaaatagataaagagctgtacaaaagcatgaagaatagattgagagggtccaatatacatcttctcagagtatcatgaaaggaggatgaagagaacgctgaaaaagcaatatttgaataaatacagctgagaattttccaggatttcaaaaagagatgagtccaccgatagaaaaagctttctaagaggcagtgtacatacataaaattaaatatgcactcagacacacaagagtaaaactgaaaatcagcaggaataaaaaggaaatcttaggatctacaataggaaacaatctacagaaaaacagcttaattaagcagagaaaccaaaagtaatagaacatatgctcacagtgccatgagaaaataattgctgtcctataagcttatagccagctaaattatcatgcaaaagggagagtgcaagcatacaaatattaagataatttaacaataaatatcctcacaacaataattactaaaggacgtacttcagcaaaaagaaaaataaactcagaggaatatctaagtacaaagataaatagtgagcaaataaataaataaaatatatcataagtcaaatatgaagtattgtatggatatgagagactggagtattcaatgagttattaaaatccatcaaggtccttgtcatatttgagaaagataaatataactttagatttcttagaataatatatagattattatgtatgccaaaaagataaccaattaaagaacagaagacaatcagatgtttccaaccagcagaggaaaaaataagaagaaaacatagaaaaattttcagtacaacaggaggtacaaatgggtgggtgaaggagaaaggaaaaggatggtcaatgaacaatgtccttaaatggcggaataagtctaaagacattaggacccacaataatacaaatgaactaaacctatctatttaagataggtagcaaactgaacaacataaatgttaataacggtagttaatacttcctattctgcaagtgctttacaaagattaactcactgagtcatcacaatagcctatgaagtttatactattagtgcaccattattatggataagcatattgagatttaaagaattttagcaaattgtccaaggacacacagctagtaggtggctgtgatttacaccaggtaggcttattccagagtttaacctttgtgaccattctattctgctaagactcaatatagtcatatgatcaaaagttatgtattattaaatattatactctagaagaagctttatggatgtcaaaatgccagcaggattattttaagtgaaaaagtatgttataaaagaatatatactaataccatccaaagtttgattaaacacacacacacataagcacatatacatactgagaaatccaccagagaacagttgtaattacttctgaatcttgtgataataggtgacatttattctgttctttatatatttctgtattttctacagtgcataactgtatgtcattttgttaaactttttttaatgagccttgtacagtgcctggcacattaatgatcaagggagagagggcaaaccacaaagtcctttcattaactaaagttgagtggaagctacagaaccaacgatgttgtgttatcttactatcacaagctcagatcctagggacaaataaactgcatacttaataaaaagattcagcaacgagaaaatcctaacaagctgcccttttgtgttagtttcaggatgtgattttggaatccaacctcaattgtggcttcaaaagaaacctgaaaataaaagcttcagctgtagaaatgcagttaaatatcagcattaaatagaacatagagcccaggaatgtcagagctgcaaatgtacttatggagattgccacctacagactaaatctctcacttatacatcaggggaaaagatccacaaaagcagagacttgtccaagtttacatagactttcatagatgaacccagactggaactcagtttttctgtcttggataaagaaactgaggtttctgacatgaattacttgcccaaaattacacagctaccaaaaggtagagccagtattctaatttggtttgacaggattccaaaatccattctgtttctgaattataatcaaatagacaattttttaattattcatagaaatcttatttaatcaacaaatttatcaattgtttattatttaatattcttcaagaatatgaaagtattgaatattattcaataatttttattcacctagcacttccattttactagcactaaagaagaaataatttctctcttctttcaggcttcctcttcctgttgcttgaatatctccttctctccatatatatgtatatgtatatgtatacgtatatgtatatgtgtatatatatgtgtatatatgtgtatatatatgtgtgtatatacatagagggagaatcaatccatcacctcaagcatttatcctttgtgttacaaacaatccacttacacccttttagttattttacaatgtacaattaaattagaaaatagatatttttaagttactatgaattggagatggagttttttttaagaattttccctgtgatctctttcctttttaattttctatgacttactctctgaaaagcccaatacttttagaaagcaggtgtcatgtcatataattgcagttctccttttaaaatttaattttgtttccgttcccttgttattttttccctgtcaacactaccaatagttgcactcacaaataggcagtaacccttgcctgcatgcctagtgctgttttcctgtattcattttgcttctgattaaacacatttgtattaagagtgtacttgtagcacagccactttctacatgaaaggagaattttgttgtggtgatgaatattgttttccagtagataaaataatttctaaatatcttctctattagctcgatattttcaaccaggcttcatcctagataaaagatcctaactgaatgtagcaggagatcatcgtcccttacaggcttccaggaaatgctctcttcactgtcaattatttatattgtgaacatccaggcaaggagactgcatagcattctgcttttgtatttttcaaatttgcctcatctttgtgatgtggaaatttgtatggtgatgaagaaagtacacattcatctaatgagtgagaaataaatagtttttattttttgaatacattttggtagttggggttagatgtgatggaattaatgttttgtctctaatgtcctaggacctagtgtaggacctatttattccaagtactctgcctatgttatcccaattcattcttcacaaatatcttacgagggaactgtcaacccattttaacatgaggcttagagtagttaagtaacttgcctgaggttgcatagctaagacatgatggagtctgaatgtaagaccaagttgtccttgtgttctttacactgaaacacacttctcttcacaatctaaacatgttaaagtgatcaagtggagaaaaagaatgaaataagaattatattctttattcagcctgacacattttaattggcaaggaaatactaaatcagttagttgttctagaattgaaccacttacattataatttttatttaagaaacacaaactgctttttaaaaagcaatgaaaggctttagaaatgtatcagttttctaacataattatttgtctgtgtgtgtgagcaagtgtgggagaaaagaaagagaaagagaaatggggtggggtagacttatgggcacgcctgtgtgaacacacacattcagctattattctaaagtggaaatcactccccagcaacatattcagaaatttagctgggagatagaagggtaggaagccacaaaacaacatttaggaaattactagcaaagtaaaaatcctggtgattaaaaacaaaaagaaaaaaaaggggaggcacaaaagacacttgaaaccaagtgcaacaagttaccatggcaactagataatgtgggttgagatttatatgactccattgttccagcagagaaattctaaatgacaccctagtggcctgacagagtcgatgcatctcccagaatgctccggcttattactcaagagtgctttaggcacagagaaagaacaagatcacagtaactttgtcagttccagccttcctaagacacttgtttcttcattctggaggcaaaacattctcaatttctggagccagtcctgaccaagcttagcagaatattagcattcttatatttacctgtggttgaggatagcatttaccttactgtctgaagtacgtgatccagtatgaatggaatcagctttgggcacctaaatccctctttgtttttctgctggaacagtagtctgccctgattcccaggcaactttagctaaggctctaaaattctgactaatcattaccattgttaattaacaacaccatcagcacaacaatctagtattcataacaaatatttgttgaaaatatattacctctaatgctaattaacaaaccccaaagtagttatcatctatagatgctcatatgtttttattactttgctacacatgaatggcaaactgaggctaagaaaacttaagtgaccaaggtcccaaaacagccaaaatttgatttcagaaatgacaacaaaaccattgccagggggatttatcttactacatcaaatcttggctgtggttgggtccaggtccaccattttaacataaacactaacaggaataaaagacacacagaatattatggcttggtcctgttgtaccccatttactgcatgggcaggctgagatatcagggacagcaactccagtccaaattaagtccaaattagccatgctcctattacctctgaatattagatcactagttgagaaaacaggctgccctatttctaggttcattatcttagctggaactccatccgtttcttgcttctcactctttctcactgaccctcaatggaaggaaaaaataaaaaaggaggaggcaattaagatgtttaagcatctattatgtgctgggcactctatttgaatatgttatctcattaaattcctaccaaaaaatctataggctaattattttcctttctgttttacatatatgagaactaagaatcagcagataaataatttccaagggttatacagtaattattagggtttaaccaagtttctttgaccctagtcccttgccttttgtcccttaacccttggcattcctctcaacatagcttgttcagattataattatgtttagagctggaagggaccagagcatgatcaattttaagagatgtaattagtcaatatgaaagtactattaaaagtaatcaaaatagagaaaacagtaggagttagctgcataaattaaaacaaacttatgcatagccttatatcctccaatatgtaattctaaacaaggggatttttttttataaaagagattttcctttttttttttttaggaacaggtgtgcatagattaggaatttctattatgccaaggtttcattcgttgcaataaataagctcccattttgtagagaaacaaggtagttaataagcaaaccagtaatggcagcttttggtgtgactatttcctgataccaccaagcagtttcctccaagtgagactagttgaagccatgcttggagatataactgttattagaactgcccatttccctcatttggtacagtaaaggttagtttcttccctcagagtggaattaggtaatcattagccatcttccatgtcacagaggtaatactattagggcataaattaatacacatagttaaaattttaatataaacttgaacagtattagaagttagaccactatttttcatgttacacttctgtaatatgaacttctttggaaaaaaaaataaaagcaagttaccagtttccagtagagcaaaatgtgaataaatttaacaactatactgtgttatcatagcaaccaatttaaaaaaaaactgatatgataaaaaatgacacaagagaacaaatgtatcaagttgttatggcaactggggaacgtgggttgaaatttatgtatctagaatccaagagaatattctaagcaactaaaataaacatttgcttattaaaacatcccccaaatagcacttacctataagcattgaagtgttttcattattttgtctgctttttcttttatttccaatggatgattttatattgtgagcatttgtattttcagttcagcttactttttggcaacagatacaccaagatgcagtttggtttgcagaaaatggtgcaaaagccaatttcaaaatagcatcctcaatcatgttttacccttttactcttctcttaacaaaatgtctattctatctgctttttctttataaagaagctcttgcttacttgatcaatcaaattcattatgttatctttacctgattttggaagtcttcccattagacaggatatgggttaaagaattatataataaatttggatatttaggaagtcttccactaatttatgcacgcacacttttcttttagtagcataactggttgttttggactaaatgttctaatggcatctgcagtttctacagaactttgcccatgctcatgtagagtatctcattgtgagagcaggaaaggtgagattctctcatgactccatgcatttttgtaaaaccttttcccagtgccactaatactcttttttccacccttctatctgcttggctgattcttaatcataactttccactgtctacccatttgagctaagtgtccctcacctttgtcctcataacaccctctgcatacttacagctaagtgccatcatcctcatcgaaatcaacataattaacataatcattatcacatatattacatattaagcattatctgtatgttagtgactgctaactacttcccaaatatcatttcatttaatcttcacaaaagccatgtaaggtagatataattaccgccacttctctatttcataggtaagggaaaactgaggcctagagtttgtcacttgatttaggtcacatactaagttacagccaagagattttaatccatgtcaacaaaataccaaagctcatttctttatcatttagttagtcactaaaattttttctttagtttgttttgacattaaactatgaactttttgagaatttccatgtgcctacactgtagattttctgaacacatgtcttatctctggtatctcctgcactgttaaatagagacataatatgaaccacaattgtgagccatagtaaaattttgtattttctagtagctgtattaaaaaagtaaaaagaaacaaaattaatttaaataatatatttcatttaactcaatatatgcaaactattaccatttctacatgtaatcaatatataattattaatgaagtattttacatttcttttttagtactaagtctttgaaatctgttgcatattttatatgtatccaacatctcaatttacacatgcagctttagtggctaccatattggacagagcagctttaactcatgcctgataagtagatatgtaaagaatgttcaatacaagttttgtggaatgaataaataaatgggcaaatacatagaaatggagaattttagatttgtatttatagaatgacccaatttacctttatggaacttttaacagtttgtttatgaggaagctaaaagtggctattttaagacagaacatagatacgtagtagtgtattcatgttgtgataattccaggattactgtcacatcctgacctatcatggagaattgcctgcccagacacttgtgtatgctgaaatccatagcggtgtatcattagtcagctcaaaaagcctcccatttttagaacatgtgttttccattctcaggctcgggtttcaagttataattcatcatatatttcattttaaaaactcctttagatcattttaatcaatgcctattaacagtaagttaagaatatacattttaaattaaatcaaaatcagcccatatcgataatgaataaataaagtatatctcagagtatcccccttaaagaatatttttatattaaagccctggatgtgctgacaccacactgaatattactggtagaaataatcaacattttaaaaatccatttacatgataacagatatactgaacattgtaatatctttgcagtcaaaaaaccaacctcgaaatcacatctcagtggcaatactgaatattactaaaacactggcccaggggggaaatctatagaataaaaccggcaattgctaagactttacataataaaattatccttgactaaaaataaaccgaagaaaaacatcagggaatgagaatatggtgattactctagaaaactttaaaaaattcttcagaatacctatatgaaaagccaaagggggagaaaagaacaaataaaaatatggctgtcatgacctaacggttcattgcctattaggatgggacccactgacttatcttacaagggaactgccaattctgcttttaatgttattaatttgagtgctaactataatagacatgattaaaaatatatcgaattagaaaaaaaaggaagtataaaaactagacaaaattgctaaaaataacaatttcaggactctgggaaatgaccaaaagtgtacaacaaattgagaaatgtttattcatgaaaaactactcaactacaggtaagagagtggaaattagtgtcagcgttgactgggcatgctcccatctccactccatccagctcagtttgctagttctattaggatgggaaaagtagtaagaaccagtatctttgcagcctaagggaactcgcttgatttggagtggaacatgagaaaaaaatccacactcagtggcattggcagtaacagtaacagtctcagtggcaagcaaaaggaataaacagtggctccagtgaccttaggttgtagtgctggttggggcatgcaaaacatcagcagactaattggtagttcaacaggaagatccacgaaatgagacggccataaagggccttgataagctattcacaccaccctgctgatgggaaagtcttaaaactgttcaggagagattagagaaggccttagtctctctatgtgtccctggctgaatataatccacaagcgcagaggagacatgggaatagaggacctaaagagagtaaaagttggcaatggcttgtaaactacttgaactatgaatggaatccccaaaccaaacacagatccatcagtagagggtggaagccttgctgattcaagatatttaggcacaaactctaaccaaatattggctgaccactaagctatgctgacataggggtgacccatagaaagccaggatttcaaacaaaagtaaatattaaaatcctgcagggaaagagattacatagattgaatgcaggaaagttgcaaacaaacaaaacacaagcaataacaaccatcagagtgggaggcagaatctagatttgctataatctggtatctaaaatgtctagtttttttaaaaacagacaagcaaagaaacatgaaagcgtgatccatgctcaagagaaaagcagtcaacagaaactctcttaatgaatacacaatagacctaacaatgactttaaagcaaatattacaaatatattataagaattaaagcccatttttaaaaaattaaagtatgactataatgactcaactaacagaaaatctcaataaaaatgaagcaattgttttaaaaatttaagtggaaattctgaagtataacatttaataactgaaatttaaaactcactagagagactcaacaacagttctgaaatgtcagaagaaattatcagtaaacttgaagattagaaatgatctaacctgaagaacaaagagaaaatgaagaaaaattaacagagccttggagacctctaggacaacatcaaacacaccaacacaagtaacgggagtcccaaaaggtgaaaacactgggaaacagacagtaaaaataagccccaagcttttaaaatttgataaaaactgctaatctatagatccatgaaactgaacaaaaccagaatagaaaaaatgcaaagcaatatccatctaaatacatcacagaaaaactgttgaaagaaaaagagaaaatttttaaggcagcaagataaaaaatatgactcattaagtacagagaaacagcaatatgattaatggctgacttcccataagaaagaatggtggctaaaagacagtggaattatatatcaaagtgcttaaagttaaaaacaaaaacaaaacctgtcaaccaaaacctcctcgggaaaattattcttcaaaaaggaaaacaaaataaagtcattcccagatgaacaaaaataaaaaaaattcattcctagagacctaaaaactggaaagaacatttgtccatcagtggccaaatagttatacaaaccatgctgtatctattcaatggaatgctatttggcaatataaaacaacacactattgatacacacgacaacttgaatgtatctcaatggcattatgctgagtgaaagaagctagtctcaaaagattatatagtgtatgcttccatttacatatttttcaaaaacacaaaactatagcaatgaggaagagatcagtggttgtcatagactagatgtggttggagaaggtgattatagagagttagcaaaaggaaagagggtttgaggaattaaaattgtcttatatcttgattacaatgatgattacatatgttaaaattcaaagacccatgtaccaaaaggcatctttactttataataattggaataaaataaaataaaaccaagaaaacccacatagttgaacactacactcacaatgaatgtattttttttttcttagagacagggtctcattctcacccagactggagtacagcagtgtgatcatagctcactgtagtcttaaattcctgagctcaagagatccttgcacctcagcttcctgagtagctaggactacagatgtgagccaccttgactggaggatgtatcttataatgtataaattatacttcagtaaagctgtaaataaataaaagttactgtgaaactgaatctaattcaggcaggacttctaatgctttagacccttcagaaatgaaagtttgttcatcctagcaaaggatcatgaataaatagttcaggtactcaaatatgtgtaatcagtatagaaaatttcacaaaaagaattgagttgatttaatagaatttacctcccaaaacacttccttgaaccaaattactggtatagttttcttaaaagtattcacaatcatacacattgtttaaacattctcagggtcagaatagctcggactaaactaagtagctcctgagtcaaaatgatatatcacataccagaatctctggaagacaactacagatgtgttaagaggaaagtttacagcagtgaacacctacaatgaaaagttaggaagatctaaaatcaacaacctgacatcacccctaaaggagcgaaaaaaaaacaagagcaaatcagctccaaagctagcaaaagaaaagcaaataaccaagataagctacactgaatgaaattgagatgtaaaattcatttgaaaaaaatcaatgaaaccaaaagttggttttctgaaaaaataaacaagattgatagattgctagctagattaataaagaaaaagagaagatccaaataaacacaatcagaaacgacaaaggtgatattaacatcaaccccacagaaatacaaaagctctgttatgaacacccctatgcacataaattagaaaacctaaaagaaaaatgtttgatatcactaatcattacagaaattcaaatcaaaaccacaatgaaataccatcttacactggtcagaatgattattaaaaattcagaaaatgacagatgttggtgatgttgtgaagaaaagggacaattatacacttctggtgggaatgtaaactagttcagccactgtggaaagtactctggatatttctcaaagaacttaaaacaaaactgccattcaacccagcaatctcgttactgtcattactgggtacatacccagaggaatataaatcattctaccaaaaagacacctgcactcatatgttcattgctgcactattcacaatagcaaagacatggaatcaatctgggtgatgaaatcatttgtctatatgcatgcgcgcgcgcgcacgcgcgcacacacacacacacacacacacacacacacacacacacacacgtttggatatattcccaatgaagaacaacaacaaaatggcgtatggtgtatcgtaactttccgtactctttgctaagactttttggacccagtagtggaaggaaataacagaagttaaactctctaccactttttttaagcaaaactatgtaatcgatttcactcccaccacacaccacacccccaccaacacacacacacacgttgttcccccacttcatcctccaccaggttccactggccacacaactcaagatctatggaatgcaaggaagaaaacagtcctggctagcttgaaaaaatttactgacacgctctcagaagaattcatgctaagaaaatccatatcccatcactaattttcagggtatggcaatggctttctcaagaatattacagggaacctttggagtatgacagcaaattgcttcaaagaggctttcttgcttttctccttcaaacatgtgtatctcatgtatgacccaggaagatatatatagattggttttctgggagttttttcctccatccacagatatggcagaaatatactaccattgatgggcaggcagacattccagcaacagatgaatattgaatacttcttataagtctactaagagctttacatacattatctcaattgacccttacaataagtttgagagatggctattattattttcatattatcctgggctttttgaggctcagaagtgtgaaataatttcccccaagtaatgcggttaccttaaaataccctatgaaaaatgtattattgctattttacaaataagagaaatgaagtgacttagcaaaatttacataaatagaaaggagttgaactggaatcaaaatgcaatttgatctgactacaaatttacacgcttatcatggtggaattcgcgtacaggctttggagacaaaaagacttagggttatatcccattctttccacttactagtaccatgaccttgagcacatttcttacttaacttctttgtgcattggtttcctcatctataaaatgagaataaaagtgataaagcatgtattgagttcagtacatactaactactccataaaaacagctggtgttatcattatcattacaatcttgtattattaacttcagctaaattaaattaattcatccaaggaattctgatgggactgtgacatagagatagttatctataaggaattgggaggggaggtcaactacctagaacaaagggaacctgggggagaaaccatagggggagtgcctgattggccaggaacactatgacagatttgagaaccctaaggtagaaacaagtgcaacaggcattggagtacaaactggaggggaattaataggcacttattaaaagtgctaggaaacatgatagctaccttaaattcttcatcttattttatctggaataagaggacccaatttttccttttaatatttccttagattataataaatcaccaaatcctattacttttgcctttgaaatttctctcagattcattgtcccgtatcattcctcttattccttctgtcatctccctgaatcaagtgcctatctttttatattcagatgcttaaaccggcacggtaatagcatgcactccattcttcacttcaatccacccatgttcctgtggcagcatggaaagcacaggatttagattaggacagggctattttgttctctttaggctttgaactgaaatataactttctgttcaaaatatgaacagaaatatgcctttctgaagtgtacaacttcgtggctttcagtatattaccattatccttatataattccagaacattttcatcacctcaaaaagaaaccccatattcattagcagttactgtctattcccccttcctccaggccctggcagcaataatctactttctatctctatgaatttgcctattctggaattttataaattgaatcatatactatatgcactggctttttccacttaggataatgttttcaagcttcatccatgttttagcatgtatcagcagcacacgctttttatggctgattaatactcccttatacagattctatatattgtttatccattcatcagttaatgagcacgagggttatctctatttttggctattatgaataatgctgctatgaacattcatatataagttttcatagaaacatatattttcagttgtcttgaatatatacctagaagtggaattgctgacaactgtgtttaacattttaagggaatagccagactattttccaaagtggctgcactattgtaaatttccaatttctatatgagaattccaatttctccatatcctaatcaaacttcttccttctggtgggtgtgacttggtgtctcattctattttgacttgcatttccctaatgattaatgttatcgatcatctttttgtgtgttttagccatttgttcatcttatttgaagaattacgtattcaaattctttgcccatttttttaaaattggattgtatttttattgttgacttgtaagagttcttatatatgctgaatacttgaccctttcaatatatatgttttgtatattttctaccactctttgggttgtcatttttactttcttaacagtaacctttgaagcacaatacggttgtgctatgtggttcaaatgcagtgtcttggtcattttgtctgtcttaggctctgggtagccagggttatagtgctgcaggcacccatgtgaatgtgatggaataacaatggggcctcagggatggaaaaaattagtgactactggcccccagggcagaatgcactttagcagtggatttagtttcaagatggcaccattctgtaacagcttaggtcatggggatgagaggagtgtttaacatgggctcctactataaggcaatgcagtcatgcaaactcctggctactttcctcccaactgcatttggagtctgtgaagactgcaagactctcatgttggagaactgctagtgtctgtggtagcagtggggaccgtgagagatgtacagcttacttttttctcgtaagaagtcctttccaactccaagccaatcttagtgggggaaagagtatggaaaagctgtacaaggattttgctgctcccttggtactttccagcacacttcagccactgcagtcaaaatatagttatatattcattgttttggtccctctttgtagggggagacaggcttcaaagaacagtatttacccatcttactgatgtcctaaaagctgtttttcagtttaaatgctgcaatatgaatataaagatacaaagggcccagaagtctcagagagtagaatttcatataaagcaaacaagaggaaaacattttccgcactcccctcacccccacccccgccaaagaaaaattcaagcagaatagaaagagtatgggaggattgtggcatgaagttaaatgctggtacatccctcataggggcttataatcctgtccatcctcctggctaagcccctagtagggagaataatgagacaaactcataccgattgggatgggggagtagcacaaagcagatgaattttcatttattaattcagtttatttccttcatttattcattcatatattcatttaaccaacaaataattattgagcacttactatgtgccatgttctgtgtaagcattgggatgcagctaggtctcacttccatcataaagttggaaagtacaaaaagtctggtagagaactgttctatgtcagcctggctctgcaatagtagacataacagaagctaaatctaaaaagagaaggccagagatattccctacctgctattctcaagctctgaagcccaggaagaacaagggacagcatctaaaaattccctatgttcctgagaaaaaggtacgatagtggctgagggtgggagatggcccctggaggaacatcataattaggatgaattgagaggctattgtaatcagtacgaatctagttagcggaggcaaaggggaagaggacattttagtgcactgcagtaagagtcagttccagtgaccaaagatgttaatggtgactatatttttcaacagaaggcagcatgcatggatgcaataaatcatggacacattaacctccccactgaagccagagtaacaaggccctacccctgtggaatttagatcaaaggtctgaggagaagaaaataagtgaaaaggagggaccctgaagtcaccaagtagaaacctagaattgggcaaacttaaatcataaagtgaattattttctctgaaagtgacagtgttttttttttttttttttgagacggagtctcgctctgtggcccaggcgggagtgcagtggcgcaatctcggctcactgcaagctccgcctccagggttcacgtcattctcctgcctcagcctcccgagtagctgggactacaggcgcccaccatcacgcccagctaatttttttttgtatttttagtagagacggggtttcaccgtgttagccaggatggtctcgatcttctgacctcgtgatccgcccgcctcggcctcccaaagtgctgggattacaagcctgagccaccgcgcccggccgacagtgttttaaataatctgctatcactggaaatagggacttaactaaatatttttaaaatagaaacaattttgaaaagtaaaatttcatatactttggttttatggcaaaaagatgtatactcactataaagtatcattcattattttagataaaatattaactttttgtggtagaactttctttaaatatttatttttcttttggaatgagaattttcacactaagtagctccacaaacactagcaaattccacccagcgttgcctccttttatacttagggaaacaaagcacttttgaccataaagttgttgctcaaggttgtaaaatcagtgacaaatccaagttccttgacttccactccagtggcattttcattatcttcaaaatttctttaacaccaaatgaaaactaccacgcacacatactttggagactcaatttccaattggatgtgaatagtttaagtacgtttacaaaagtaaaattttaagaacaaactgttcaattttcctttatttaaattctctatagagattactaatgataaataacatgcaaagtatgcaatcctaactgagaaaataggtgagccaggcagtggtgtcctggtcagtgtttcacagctggttcctagtggttgaggggcctaattagtggaggctgctgatttccatagtgtaaatagtcccactataaccaatttcaagttatcaacatgatgtcaaaaaagtgggaagtttaaaattatttgaaaattttaaaatcaattttgcaagcttattacaagttggccttagcacactgctgggaccagggttgtttctccagagcaaagactgacttaagcatttacttattagaattcaggacattttatcaggacaatacactgaagtgctttaagaacatatatccacttagtatggataattatcatgaaattggtgtacttttaactacatgtggaaagtagctttttcttgtaatttcccccagccaaatataaaggaaagtgttaagtcttcacgcacatgcagttctctgaatggaatatttaagagaatagaaattaagtgtaaacacccttttgtgagattcacataaaaagaatcaaccatatctgtttaattttggcaccttatattcctctcatatgacacaacagaatagctacatttatacaaagtctaaatttttctcctttctacattataaagataaaagaaaactgagggcagttttaaaatggcttgtgaaatgtggtttaggcaaaggagtataggcacaagattgctaggcctctatacaatcagagagctatataatttggcagacctttctacgatgtaatattgaactttgccctttatagttgacatattactaaaatgatatgtctgtgttacattgtgaaaagtcaactcacgttttagaaccagagttctgtttttttcttgatcctagatatctttggaaatctaatgaaaactaatgagtctaatgaaacacttttaaagaacaatgcacatatttatagatacagaaaactttgcataaaatgttaaaggactcacagacattctgtcacttgaccatgggcttctagactcacaccaagaaccattttaaagtgtattaagaaatcttgacattcaaaggaaacccatgatgattattttagaaaagctatacaattatctgtaaaggaaagcaatcaccttaatttatattttccttaaattaagctttttaaacttattgagtttacttatgttaagtctagatttctagacataaatttctgaaagacatagtcacagatatgaggagtaaagggatctttagagataaaataccataccacaagtcctttattttataaacaaagagaggacctaagcactgaaccaactagaacaaaatctccatgaccgaggaggcctcataccattgtataaaggatacatccctggacaatttcagaaatttcagaaaccctgaattctagtaaagtcctgccatttattattcgcatggtattgggtcatcatttagcttctctaatgtttcctcagctaaaatcttagttatactacaaagttgttacaaggattaaatgaggtatttgtgaaaacagtaaatattctaatgccatgtaacaagttaatgaaattataattatgataaataacagacgaacgacatgcattcttcctgtcgggaccaaacttattagacgcaggtctagccaacacctaagacagtcttttataaagaaaaaaaaaagtggctcaaaggtactgagattagtggtcacaggaaagacttctggtataagtgggataatggaaaaagcactagattcggaattaagagatttcgttgtagttccaattctactactaactagtaaaactgaaaaattatttcagacctctggccctccatttttgtggagagcagattttcttaaacatttgaagaagtgccacagccagacccctttaagaacacactgaaaattatgaaaattctccccacaaaaagtatacatttggcacatcattgaaggatctcaagttagctattaaatttccacaagtggcatactaacaacccagacattacttataaattgtttctagaactaaatcaatttatatatatgaaatattctataaatgtacacattatagaattatagaattttgagaagtaaaattgaaggcaagtttacagatattttatgtgaaaaatgtttatatttagtaacagttattacaatattggtttctatatctacaacaaaaaggtatcattttactaccataattaaaaattatctactaaccctttgctacttttatgataaaatcaaaactcattattttggcatttctaatttgagttcaaccagctttttgcctcatttataactattcttctcttacaaccaccccatctttctcttacctcaagtcacttgccacacttaaattctcatcagttgatggatccagtggaacttttcatgctagattcactggggctccgtgcttttgtacctgataatctctctgccaaaagttcctctgttatcctaattcacccagttatcttcaagtttcaggtctaatgtcaaccttccccacacatactttggagaactagttggcagtactataaagttaaatatatgcctattttaggacccccaaattccactcctagacatttacccaaatgaagttaaagcctacatccacaaaaagatttgtacaaaaatgttcagagcaactttattcataatagccaaaatcagtgaataactcttcaatagatcaagttgtgatatatttatataatgtaatactactcagcaataaaaaggaatgtaaccactaatgcatacaaaaacatggatgaacctcaaaatcattatattgagcaagataagactgacaccaatgcacacatattttatgtttctatttacaagaagttctagaagagacacagctaatccccagggacaaaaatttaaaaaagtctaaggaataatgtgtgaagtgattctaaagatgcatcagagaacttcccagggtgatagaagtttatggtgaagtttacataattatatgcgagaatcaaagttcattgaaccaagcacttaaggtctatgcgtgttattggatataaattataactcagctattgcttggcttgatattctaaatattaattctgaaattcttcctctattataatagatctatattttaccaaccactcaaggtgattcttatgaagatggctagttgacctctctttggaaagtaccattgatgagagtttaaaacttgcccttttactaaaattatactttccacaaaataataaacaatatatagagttctaaccatgactttagacagttgtataaatacacacagtgagccacaaatagattaagccactgttcacatagtctagactctagatcccaaacctggatacacttcagaatcatatagaaaacaaaatatagaactttgggttctacccccacaccaagaacgcagaatatttttgtagtgagacccaggaattactttttttttttttttaagttttccctggagacagtgacatcaacaagatggcagaataagaacaaacatgctcatttcccccacaacaacaacaagaattctgtactcacccacatccaaaagtctctctgcagaagtcttgtgaattcagataggaggttgtaaacccccccatggagcccaacacctaggggggtcatttcgagagtgcacaccagcacccaggtatctgattcaacaattgtgctccagggttcaagcctagaaacagcccacttgccaaagagcttagctatagccctctttgtcttttagcctgctaccaaaaccatctgacacggggttgagatggaatcatcttagcaaagaggcttgtctgcctgtttaaatcagtcttgacagtgaatctaagagttatccagtggctcagctccagccttctcagttgaagtcccagctcagtgctgttcacggaagaatccagaaagagatttgttcatatctcacagcccaggcatctgagcctgcatgagactatcactaacctccatcctacagcggttcccaaggcggcccagtctcagcatcagccccttgcattgcagttggagaactaccccatctatgcagggacttgctgggagatgaatatttctctgagccaataaggctgggttctgcagcctctgtcccacagcagatatggaggtggtccagtctcagcttaggcccctcctgctgcagtcaggaaactatctttgcagagacctcctggagatacacatgctcattagagccaatgagaagggttctccagcttccttcccacagcagatcccaagggacctccctctcagctccagccccagtctgctgcagttgggaaactatcctgtttgtgcatatacttgctaggaatcacagacctgtctgagctaatgaatctgagctttccagcctccatcctgcagcagatcacaaggggccccatcagctccagctccttctgctgcagttgggaaactaacctgctgggagactcatgctcctcatggctaatgagaataagctctccagcctccagcccatagcagatcccagtgtagcccagtctcagctccagcccctcccactgcagttgaggaactatctaatctgtgcagggacttgcagggagacatgctcccctcttagccaacaagaccagcccctccagcctttgtcccatagcagatccaaagagagccagtctcagatcaggccccacccactacagtagggtagctacgctatctgtgcagagatctgctgaaagacccacacacctctgagccaatgaaacagtctcaccaatctcctttctacagcatctctggagagggctgagtctcaacttcagccactcttgctacagttgaagacccatgctgcctgtgctggagcctacatgtagaccaccaagacagtcttctatacctaggtccctggccagctttcccacacagccctggtatctgacttaggtgttccccaggtctgtctggcccagaaagctgtgaatctcaaagcccacgcaagacacatggcttgggtgccctttagtactggggtagctgtagtggtcacagtctcatgggacacaatagtcagtcttcttagagtctctggaaggtcctctaaagaagtacaggcacaaaaaagactgcaaagtaaaataaatacctatttcctcaatttgcagaaattgttacatccacaagcatcaagaacattcagggaaatattacctcaccaaatggacaaagtaaggcactagagaccaaccctaaagtgatggagatgtgtgatctctcagacaaagaattcaaaacaactacttcaaggaagctcaatgaacttcaaagaatacagaggatgaattctgaaatttgtcagagaaatgtaacagataaatcaaaataataaaaaaaattctagagcttaaaaatacaatgaatgaaatgaaaaatgtaatagaatcaacaacagaaataaaacagaagaataaatgagcttaaagacaaactatttaaaacacagaggaaaaatgaaaaaaatgaaataaagaaagcttatggactctatggaacaatgttaaagcaaatatttgtgttattggcattaaagagggaatggagaaaagcaatgtgataaaaagcttattaaaaaaaaaaacccaaaactttgcaaacctggaaaaaaatataaatattcaggtacagaaaggtgaaaggtgaacaagcatattcaacccaaataagaataacttaagacatattctaatcaaattgcaaaggttaaagacaaagaggattctcaaagctgtgagacaataaaatcaaataacatacaaggcagattcaaatatataaaatagccaagtatataaagcactggagcatccaaatatataaagtaaatactaatagatctaagggaaaaataaactgcgatataatagcattagggactttagcaccctattttcagcaatggacagatcatccagatagaaaaatcaacaaggaaacatcaaatttaaaatgccctctagaccacatagacctaacaggcatttatagaacatttcattcaactgctacagaataaatattctttcctccagcacatggaacattctccacaatagatcatatgttaagccacgaaacaagtctcaacaaattttaaaaggtcaaaataatattaagtctcttttctgaccacgatgtaacaaaagtgaaaatcagcaaaaagaagaaatttagaaactttacagatacatggaaattaaacaacatgctcatgaacaaccaatgagtcaatgaaaaaatcaaaatgaaaattttaaaaattctcaaaacaaatgaaactgggagcactttcataccaaaagctatgggatatagtgaaagcagtactctaagggaaatatataacaataaatatctacataaaaaatctaaaaacttcaaataacctatcaatgcacctcacagagctagaaaataagaacaaacccaacttatattattaaataaacttaatattaataataaatttattatttaataataaatatcagttctaaataaatatcccataggttttggtgtggtgttttctactttcattttccattacttttaatggcaaaaaaagcattacttttgcaccaaactaatacaacacaaaaataaacatcagaccatatataaatgaaattgatactaaaaaaatacaaaagatcaatgagatgaaaatctggttttttaaagacaaacaaaattaacaaacctgtagctagattaagacaaaaaaagagaagagccatataaacaaaatgagagaagagccatataaacaaaattagagatgaaaaaggagacattacaactgataccacagaaatacaaaggatcattagagacaactatatgccaacacattaggaaacctagaagaaattagtgaataaatttctggacatatacaacttaccacaagtgaatcaggaagaaatagaaaacatgaacaaataagtataatgagatcaaagaagtaataaaaagtctcctatcaaaaaaatgcctaggacctgatggcttcactgctgacctctaccaaacatttaaagaagaactaacaccacttctactcaaactattcaaaaacattgaaaagaaaatacttccaaactcattgtatgaggccagcattaccctagtaacagaactagacaaggacacagcacctaagaaagctacaggctaatatgcctgataaacatagatgcaaaaattctcaataaaatactagcaaactggataccacacattaaaaacatcatttaccataatcaagtgggatttagtccagggatgcacagatggttcaacctacaaaaatcaatcaacataatacatcacattaacagaatcaaggacaaaaacaatactatcatttcaattgatgctggaaaaacatttggtaaaattcaacatctctttatgataagaacttttaaccaactgggtatagaaggagcatacttttaaaatgataaagtccgtatatgacaaaccgacagctaacaacatactgaatggggaaaaattgaaagcatttccataagataccgaacaagatgaagatgctcactttcaccactttcattcaatatagtagtagacgtcctaaccagagcaattagacaaggaaaagaaataaagagcatccaaaatggaaaggaagaggtcaaattttatccttgtttgcagaagacatgatcttcttgttagaaaaacctaaacactttagcagaaaactgttagaactaataaatttggtaaagttgcaggatatagcatcaacatacaaaaatcagtagcatttctatatgttaactgcaatcaatctgaaaaagaaaccaagaaggcaatcccattaacaatagttaccaaataattaaaatacctagaaataaatttaaccaaagaagtgaaagatctcttcaatgacaattataaaactctgatgaaaataaattgaagagaacacacaaacaaatagaaagatatcccatgctaatgaattggaagaattactattaaaatatccatactccccaaagcaatctacgaattcaatgcaatcctttttaaaacatcaatgacattcttcacataaacagaaaaaaaaaactcctaaaatttgtatggacacaaagatcttgaaaagccaaagcaatcctgggcaaaaagtaaagctggaagcatcacattgcctgacttcaaactgtactacaaagctacagtaaccaaaacatcatggtactggcataaaaacagacacacaggccaatgaaacagaatagagaatccagaaataaatccacacatttacagtcaactcattttcaacaaaggtgtcaagaaaatgcattggagaagggacagactattcaagaaatggtgctgagaaaagtggatatccacacgcagaaaaataaaaatagatccctacctctcactttacaccaaaagtcaactcaaaatggagtaaagtcttaaatgtaaaacataaaactataaaactaacaaactaaatgtccatcagtgaattaatggataaagaaatatatataattcatatatatgtgtgtgtatatatatatatatatagatatatatatatataacaatggaatattattcagccataaaaagaaataaaattctgtcatttgcagcaacatggatagaaatggaggtcagtgtgctaagtgaaataaaccaggtacaaaaagacaaataacatatgttctcaaccatatttgggagctaaaaaaaagtggatctcatggaggtagaaaatataatggggttaccagagactgagaaggctataagggaaaggaggttgaagagaagctggtaaataggtacaaaaacacagttcaatagaagaaaaaagttacagtgttcaatagtatagtggaataactatggttaacactcattcattgtgtatgtatgtcagaatagctgtaaaagaattggaatgttgccaacacaaaaaacagataaatgtttggggtgatggatagccctgttacctggatttgatcattacacattgtatacatgtatcaaaatagcgcatgtatccccaaaatatgtacaactattatgtatcaattttgaaaaatctaaaacataaaagttccctatgggattcaaatgagcagcccaattaggaaagactgacccagacagtaagtattagcaaagaaagagatcagagtgtgatgtggttatctattcaactatatcttctccttgtatcaaaaagatttctaagacttactcaagatccaatctttttgttctacattttttcaaatgtaacacagaatacttgcattcctttacataatcaatagacacaatgttttatatagcattatatggtttggatctatgtcacccccaccctcaaatctcatgtggaattgtaatccccagtgttggaggtggggacgggtgggaggtgatttgatcatggggggcagatttcccctactgtactatcctcaagataatgagttctcatgagatctggttttttaaaagtgtgtggcacctccctgatctctatcttcctcctgctgtggctatgtgaagtgctggctcccccttcgccttctgccatgattggaagctccctgaggctttcccagaaccaggtgccagcatcatgcttcctgtacagcatgtggaaccatgagtccattaaacctattttctttataaattactcagtctcaggtatttctttatagaaatgcaagaacagactaatacatagtagaaagacctaagaatttgaagccagatagacctgggttggaattctagctctgccccttcaaagcatgtgacgttgaggaagtcatttatccacttgaagtctcaaactcctttttggcaaaaaattgagttattgatatttctttgatataatgaatatgaaagcaccaaatacatggtatataagtaataaaggtttgctttattttatcccaataaatgtgaacagatatttctacacttcagtaaaacaaaataaaatgggaaatctcctgaatttgtaatgaagtcgattctactctattccttcttactggttagaaagtgctaatcttctgggcgtggtggtaggcacctgtaatcccatctacttgggaggctgaggaaggggaattgcttgaacccgggaggcagagcttgcagtgagacgagatcatgccactgcactccagcctgggtgacaagagcaaaattccttctaaaaatgaaaaaaagcgcatatctttttttttaatttcaagtccaatgtcatcacatgtattttttgtcacaaaaaaaatcttcaaagattcatttatgtaacttcaatttcctctgggcagttgtttttcatagctacacttaccatagttctaatggtataattcattatctcatcatcgactggacatttcatcaaacacatttcactgttgagacaacttgtcagtgatattcaatttgctgtctcatcagcaatatagtatatagtaattaaatttttatcatggcatctcatccctattgctcatccataattcatatttttctgtcaaacatcaaccctacatatattgtactaatgaggagggaaaacagagtttaccttctcagatgtcttcttagactgtgtaaacaattgcattctttttctaagaggagggctagccaaaggcacaattgtgaagcaaaagccctactcccccagcctaccttccaggtatttgccaacctacacatatcatctacaacaaattctctctaaagtactaatgattatttaaaacaattataaatccaatttatctttcaagctgtaatgcaaaaactactccttctatattttttattcttcatcagtagcatttgagctaccaacttctggactgaccttcccattattttgtgaggttaccagtgggtaagttcaagtccttttttaatgcaattctcagtgcttaacacaatgcttggcacatagacccattacatgtgtcaaattttatttaaatgagtcaattttatattctgagagaatatttacattttgaaagaaatatgaaaagaatgaaagcttatatatccaaaaattcatattttggcacttagatgaaggagatatttatatatggggtgggaatggaactttcttatcactactcaaattatatcacattgtgtgcagactgtttcacccactcatctatctctccagcctcctttttacccctagactctaacataactattccttctgcttgattgccctttcatgccctctacatctggtaaactgctttttatccttcaaaacccatttcaaaagtaacctcctccaagaagcccttccaggcattctccacctcttctgagtttccagaagtggcatactgtgtttatgcctctagtaatagtacatagctaccagcaatggggtacttactgtggacagacattatattagatattttatagaacttacccagttttattcttgttagaaccatatgaaatagatgttcatttcattcttgaaaaacatattcaaagtagttaagtaacctactgaagatcacacaggtggtaatcaacaaagcaggaatggaagctagactctgactccaaagcccagaatattttccatgtatcatacagtttcaaaattaatgacaaaatgactgaatgaatgatgactgtgacaaaggatagcatgtcctcatgagcacacatatggctaagataaatttcaaatttcactctctcttccacattttatatttgatatgctagcgtatactaagatacctttgttaagatagctaaggcatgcagaaaaaaaaaacaatttcaatttcaatatgatactcttagaatcatgacaaagaccttctattgtaactaagcattttagaacacagttttgcaactcaaaacctcagtgtcaagccagtcttattatgtgttctttccatttaagcccattctgatcacattttccctggatcagccccagtggtcccaacagggagctataacatgcacaaaatgtctgctgagccaggttaaatgaatttcagttaagggactaatattattaacattatatgatgatttgcaattatcagtcaaataagatcagctaccagagaaccagggagtccttagtaagaggtgaaccacaaaatcagcacactccctcctcaatgagtttataatctaaatgggcaattgcaaacaagggagggatagaagggctctccggggagaggtgagaaggagtccttcatttgttcttgtcctcaatgaaaaaggcttatgtaagaaaacaagttcaaccgtactcccctatctaccctcccgcaatatgtaagtcctttgcaagtacactgggttcatgcactgataattgagaggtggctgtggttcagcaaaaagcattgatctggactttagaacccaaggattctagtcctaaatctgccactaactagctctatgaccttgctccctaactattcatcttctacagtccctgtttctcatcaataaaaataaagatcacactagttcaatctgagagcctccaactctaaaatgcagtaccttagcactgaatacaaatacttagttaagttcaatttctcccactctgtttccaagctaatatcaatgttgattttttttagatttttagcaacctgccccagtatagattcttcttgtactagggctggtacaagaaggcatcaaagaccatggagcagaattgtttacacaattctgatttaatgcctccagctcttctctgaacttatgggcacaaagaaatcagtcttttttttttttttttttttttgagacagagactttctccctgccctgtccccaggcctgcaacctctgcctcccaggttcaagcaattctcctgccttagcctcctgagtagctggaattacaggagcacactaccacacccagctaacttttttttttttttttgtatgttcagtagaaacagggtttcaccatgttggctaggctgatcttgaactcctgacctcaagtaatccacccgcctcggcctcccaaagttctgggattataggcatgagccaccataaccagcctagaaagcagtctcttcaccgaaattcatttatataatccaaaaatttctttataatctgaccttccaatactcctctgatttcatctcctatttccaatcatggactcctcttcagctgcctccttgctggtcctctgtcacaccaagcagactcctgccctcagaggctttgtaccttttattctccctacctagaatatctccctttttcataactgcctagtttgagctctcactttcttcaggttttcattaataagtcactttttcaataacacctgccctcatcatcctttctgcccactcaccatttcatatcctccatccctactttattctgtcctgaactttgatcataatctaattaattatttatcttgttgatcatctgtcttccccattagaatgtaaacccagtaaagacatatttttttgggtcagtttaattcccttcaatattccaagtacctagagtagtgcttaggatataggaggcaggtaataaatatttgttgaacagatgaataagccctcatgtctcaccactctccccctaattcactgtgctccagacacacttgtcttctccttcccttatcatgcacaccaaacatcctctccctcagagcctttgtattgtacttccttctgcctcggatctcctttcaaagatatccatatggggttttttcccacattttattcagacctatatccaaatgttgtcatgtccaagaagccttctcaggtcaaattatctaaaatggcagtctcatttttcatacacttttcttatactttttttttcctttataaccgtggcagtggtggaactaagccactcagatctctttcaaaagaactttcttggggagcaaattgactgacagtcccaactgtctgtattcacctctgcatgctctgaggccaagccttccccaagatggtcccagccagtatttcagcacagcaggaataatactttaagactattcctaatgactcgggactcctctaataggcaacttgggctcaggaactacccatcaacttagctgaaacttctttaaaactgctacaatctgagattcttcttccctaaaccttcttccttctcccttccatttcacaggcttcagacctgcataatagcctgaaggctctcctgtctaatcttattccctccccttcatctttcacaggtatctccccctttaaatctcattcttataccatctaattctgtcttggtgtttgcttcttggagtacctgaaataatacaataaaacttatagcatattcaatattaatttgtttatttgtagttgctcatctctacctcatgaaggttgagacttggtctgttttattaactactagatctacagcatgtagaatgatgcttgcaaagaccaaatatctttggtagacaaatattactgctacatattatttcatttatttgtgaaagaaaataatgagtgtctagtatgttttaggcactatgttaagtactcagtagatcaagggtctagtggaagagataaatatataaacgagtaattataactcactatctcaaggatttattaaaagtattcacaatgtatggagcacaaataacttcataaacagttaataatttaaatcctatacatgtttaaggtattgttaatatcccatgaactatagaaagggtaattcaaccccaacaactaagttcccttgtctcagccaagacctcctcagaagtaaggtgtcccttgtgaaaattttcttcaggtatataaagtgaagtgaaggctatcccttgctgtataagagtaccctgctcaagattacactgattggctaggtaaaaaaggtaaataagtttgtggttctatgccctaggaaaacaatctgtgaaccagataaattattggaacttttctagctcaagcttcaaaaaatggtcccatgcaaatatcacctattctatgaacatttatgataccctcactactcgtcgaggtcactccttttatatgttgaagcactctgtgcttctccttcctagcagttaccaaaagtgtaatttattagtcatttgggagctatctcattagtagataataagctccatgagaaaactacatctattatattaactgctatatctccattgcctggcaaggaaaaaggtctctatatttcttgaatggctgtataaaataatgactgattaattaaatgaaaagtttctgcttatctacctaattgtaaaaattatctccctcatcaaaattcccattgcattttatctattatcttacactccccctctatccatcatatatccatatatcccaccttatatccatatatcccctatatccattcatgatgtagatataaactttacaaataaagaagagtagtacacctcgaccccactagtcacagaaaaattgtcagtctttggattcagttgctcttgagatcattcatccttcccagatgttgacaccccgaatcgagatttgaaggtgacaagtaatagtcctctgatttccactcactccctctcctctcccctttctttctccgtctttctctctctctctgtcttcctctctctttataagaagctatgaaggcagaagcatagtaaaaaatgaatgggtttgagttagaaattctacttggtctgagttccatttctgtcttttccatcacaactgatttgctgatcattgaggactgactgtgctgacttacaggaaaacaaccattaatattaggaaaagcctagagagatgaggaccaacaaaatctctagttgagtaatgtaatctaacctgaaaatctgtagcaatcaggcctacaagagtaacaaaaactaatgctcagcatttctgcatctgctatcaaaaaatatcaaagcactctcacatctactatctccttattttccctcactataatctttaagtgctaggcaactaaggcattgagaagttaaatgacctgcccaaggtcacacagcaaactgatgactcatatctcaatgttctttctattaagcaacagggaggtaagttgaacatctgatcaaataaaagacctttctcatcctattacctcaactgtctctctatgtctttaaggcatgaaattaagaagtaaccagataaaagtaagatgaaaactgctactgcctttgctacaaaatgtgagtaggtaggctttgctgtaattatggagaatacatatctgatttaactcccttatttctttactgtctggatatttggtaatatttgataggaccacaaaggcataaaatgaagaaagagggaaagaaaaaaaaccatatagataaatgtagaaacattagaatttgccataatgattccaaagggtctctcagagttaaggtagatgctgttgatgaaaagagtaaaattctctaaaatatttgaagagatttattctgagccaaatatgagtgatcaatggccgctgacatagccctcaggagatacagagaacatgtgcccaaagtggtcaggctacaacttggttttatacattttagggagacataaggcatcaattaatacatgtaagatgtacattggtttagtccagaaaggcaggacaactggaagctgagtgggggtgggggtggaacacttccagttcataggtggattcaaagattttctcactggcacttagctaaaagagttattatctaaagacctggaatcagtagagaggaatgtctggggtatgagaagcagttgtgaaaaccaaggttttattatccagatgaagcctacaggtagcaggcttcaaaaagaataaattgtaaatgtttcttatcagacttagtctattttatcagcctaagttctctgttgatgttaatgctggtcagctgtgaggcatgtctgacccatccccctgcagttctgaactaccagttgatttctaggagattctactatgctgtcttaattagaacctttctatgtctcaactttggaatgcccttggtggacaggaagggtatgttcaggtggctgggggacttagaattgtattggtttacaatgcactaagaggactttagggtcctgccttaagaggaaccttagacagaaggtgatagtacaatggaaaaacagggaagaaagtgggagcaggtcacattgccacaggcctcagttcatatttctaacccaaaccccaaagtaaagaagataagctctgcatcttacctgctccttttgaatctcctccttctcattatagtaggttagttccagggctccgctaaacttcagggtagaacaagaaaattacctcagcccatgctgttcactcctaccatgtcccgttgtgagccccataaaagctgaatatggagatttctcatcttcccagtctctacggtctaccctctcctttcagctgctacttttttctctatagctcaactcctttttagctctcgtcttgattattaggacaaccttctggttctttttacttcctccagtgtcagccactcaagtcattgcttgacactatttcaaaactcacattcctgaagtagatagctgatctctacaacacctcgcaaaaatctttgaaaatttctcaactaaataaagaatacagttgaaattcctcaacttcatatgcaattcttacccatctctccctacacgtccctgcccactaccaatatatactccactgtggccaattaaattcacaaacctgacttgcatttactcatctgacactactctcacacttttcccagagcctaggatatcctcccacaagtatctacatctctttttgcagtatatgtttcccctctcatctgaatttcatcttgattttaaaatatcctaagctggtctccaagactacttagcttcaggtgataaggcttagctcaacactttggatatccacataaaactactttaaacttttgttaaatttatcttcttaaattaggaaacttgatttttttatatacatacaagaccaataaatactctgtaataaatattcagtttctaagagaccagtaactaagacttttccatttatttgcctgggtgctctgaatgataaatcttttatcaaaaatagagagatttgtgggtaagacaaattgctccataatactttcacaatgaaaacttatccaagtcagatctggccccaaatatcaattccctgtgcatttgtattctgacgaacctatcacagtgacctattttcataccagtgactaagttaagaacgtgattgcttttgaaagaaactgaaataaaaattccaagaatggtattaggagaaatgaataaatcaaacatgattttctacaaacacaagttcataatttaagcctgctaaaacatgtgtgtattttcagaatgagaggaggtgtttgatgttataagtccattgtgactgaataaaaaattacagaccagttcagttttttaatggcattatgggtgcttactaattttttgctaatggttactgataaaacaaaatttaaaacataaacgtttgctgaatcctgtgaaaatctctttttctcaaatactttcatttaatttatttaacaattatatatgaagaacacattctgtgtgctgaaggaattcagaatatgccacctcaaaatattccactttgacctaaggattattttgagctgaaagcaattgagaaaaagtagacaaagagcaaactctctgccctcaccttttctacaaggaagggcaagatgatttttaattataggagacgattctagactcttaacccaaagatgttccagaagaatctacataacaaaatcttactaaaacaacccttatcttccattagtttcctcatatatttacagtttgctacccctaaaagcctatttttctttgtcttgtcccttctctacaaatttactcttctttgttaaaatgctacataaacccaagttcctaccacccctttgaattacacaatgcatgcattaataaacttgtttgtttttctcttgtaatatgtcttttgtcaatttaatttacagggaatgaacctaaggaagtagagagaaaaaggtttcttatccctcatttacagtttcaagaacttaaaatatacacaatgcttgtcttcaaggatcctaaattctagtgaagaaggacaattaaacagatcattaggatataaaaataatttggaagttaaaaaaaaaaaaaggaagcacagactggcacaatgatgtgcatttgtagtcccagctactccagaggctgaggagagaggatccctgaatgcaggagttcagatccaccctgggcaatacagtagaaacctcatctcaaaaaataatagtaatggtaaggaaagaaagttttttaaaaggcaggcaattaaattagatttaaaacgacaagaaagtcagtgggctaacacaggatcatacaaatagccagtcttgacccctccagactttacgttcctacttatttatagcaaaagcagaaaataggccatttttttcatggaaataagtaaagtacctaaaaaaattcaacaggattaaaatccaataataagactacagaaatatttaatgtcattaatttatcttttgtgtttgttgttcatttattcatatctttgacaaaagcttttgacaagcatttttgcaccaggtttgtatgcagttatgggagattcctaggaaagttatacaggttccatactgcaagttatttaaagtcctgtagaacttcatcagttttcatgacattagcatgtttgaaaaatgggaacaatttgatttaggtaggtacctgaatataaatgtgaatcacagaatcttagggtcggtcacctagttgagaagcacccttatggttaaaataccttttttttttcttggagacagagtctcactctgtcacccaggctggagtgcagtggctgaatcttggctcacggcaacctccacctcccgggttcaagcaattctctgcctcagcctcccgaatagctgggattacaggcacctgccaccacgcccagctaatttttgtgtttttattagagacggggtttcactatcttggccaggctggtcttgaactcctgacctcatgatctacccacctaggcctcccaaagtgctgtgattacaggtgtgagccgccgcgcctggcctacaatatctcttataataattcacatttgtatagtacttcataagagttgaaaactcataagacttttaaatattttatttcattttatccccaaaacaatattgtgatattggtaaaacaaatattaactcacaaagagggagagtaagactccaaaagataaaattataatttttttaaaaaaaggaacagaactatgatatgaactcaaactcaagattttaatccaatatgtgttctattaccactcaatcctttaaaggtcacacttttaaaatggatataccgcagatcccaccatcacctagattctctctctctctcacacacacacacacacacacacacacagagtttcaatcatgcacacagagtcaattatacacaattgctaaaacatgaaattctgaattgcaagtctttgcaatgactcccaccttaaaatacaatacatcattttataaggaagcctccctccttttctatccttgtccaaaaccaatcaattaaacaccagagtcaagataactttggaaattccaggcaattctgaactaccagttgatttctaggagattctactatgctgtcttagttagagcctttctatgtctcacctgaattatcccagcttattcctatgcaacatactccagttgaaaccactcaatcacaagtacagctgaactcaattcaagcattttctaaattacaccacagtctctcctgattccgtccctttgcacatgctttcctctgcctgcaatgctattcccttccctatgtatctggtttatttaaaagttacctcttcggttgcttttgtggactttgtcaaaaattcttaccaaggccaatgtcaggaagagtatttcctagattgtcttctaggatttttaaagtcttacttttttttgaaggcttacatttgaatattttattccctttggattaatgtctgtacattgtgaaaggcgggggtcaagcttcagttttcagcatatggctagccagttatccaagcaccatttattgaatagggattcctttctccattgcttgtttttgtccaccttgtcaaagatcatacaattgtaggcatatggctttatttctgagttttctatcctgttccattgctctacgtgtctgtttttgtaccagtaccaaggaattgcaacaaaaacaaaaatagttaagtaggaccttattaaactaaaaaggttctgcacagcaaaataaactgtcaacagagtaaacagcctacagaatggaagaaaatattcacaaactatgcattaaacaaatccagaatttgtcctatgcaagaacaaatatctagaatctgtagggaacttaaataaatcaacaaacagaaagcaaataactccattagacaatgagcaaaggatatcaacagacacttctgaaaagaagatatacaagaagccaaaaaacatctgaaaaaatgctcattatcaccaatcatcagagagatacaaatcaaaaccacaatgagatatgatctcacaccagtcagaatggctattattaaaaagtcaaaaaacaacagatgatgatgaggctgtggagaaaagggaacacttatacactattgttgagaatgtaaattagtccaaccattgtgggaaattgtctgaagatttctcaaagaacttaaaacagagctaccatttggcctagtaatcccattactaggtatatacctaaaagaaaataagtcattctaccaaaaagacacatgaactcatatgttcctggatgcactatttacaatagcaaaaatacgaaatcaacccaggtgcccatccatgggagattagataaagaaaatgtagtatatatataccatggaatactatgcagccataaaaagaatgaaatcatgtcctttgcagcaacgtggatgcatttggaggccatagtcctaagcaaattaacacaacaaaaccaaatagcagaaaaccaaataccacatgttcttacttatagggggaagctaaacactgagcacacattaacataaatatgagaacaatagatgcttaagactactagagagggaggcaaggagcaggcatgggttgaaaaactacctatcaggtaccatgctcattacctgggtgatggaatctgtaccccaaacctcagcatcacacaatatccacatgtaacaaacctgcacatgtaccccctgtatctaaaataaaagttgaaattttaagaaataaaagttacctcttcataaaagctttttctgacacctctggtctctaggctagattatatactccacttctgtgttctctgagtttaattctcttataacactttcattacaatatttttccatatattagtacttctttagtctctgtcactagggtataaactccttgaagacagagagaactaggtcatttatcacaactccagtgcctaacatactgcatgatggtcaaaatagaatcccaaaatcaggacatcagcatggccgtgttctccctgagggttctagaggaggatattttcttgcatttcctagcttctggtggttgctaacaatcctgatgttcctttccttggagatgcatcactctaatctctgacactgttatcaggtggcattctccctgtgtatctatatctaaattcccatctccttataaatagtagccattaagttagggcccactctaatctagtatgacctcacttaactagattatatctgcaaagaccttacttccaaataaggtcacattcacagatttttgggtggtcatgcacttcagggaaatgcgatttcacctagtacactgtgtttcaactggagagaggagaatctgaaattctgcatttggagaacagtactcaagcaaccaacccagctatatttgatttgacatcccaggtcactgccttatttatgaaaccgaaacttcccacaagaaattacaactgctttttgtcttaatttggagagtttattcattcattcattcctccactcatccatcacatatttatgaagtacctttaacatactagtggtatggatataacaataaacaaagcatacaaaaatctctgcccttgtgaagcttacctgtgagcagtggggggagacagataaagaaatatgtaaaactctgcacatgatatcaaattttggtaacttcagtggaaacatactaagcaggaaatggagataggaaagttgaatggggttggaaatgttgcactgtttaacgtggtgactaaagaaggctccaccaagaaggtgctatttaagcatctaaagaggtaaaggagttagccttgtggatatttgggagaatatagtttttaggtagtagaaacaaatgcaaaggccctagagtaagagtgtgcctggggagttagagataagcaaggaggccagggtgatgactacaaagataagagagcagtaggaaatagggcctggggggtaatggaggatagtacagagatcaggatgttcttcctctctccactaccaactaaatagtcattgcaagatgccatgttcctagtttctacatagggtacattttgagctcctaagagacaagtttattatatcaaatagaaaaaaaaatatatatatatatataactttatttcacaaaaatgaaatgctatgctcattaaacattaaaattcaagtaattttagtgtccttcatctgtctgccttataatcaggaaactagaaacaatgtgggtatctagattataataaataaatatttatttttagataagttatacttctcatgttaaaaaatactttctattttaccatatcactctatatatgacacttgatttatcacaatttgtcttggcaaaataactatcaaactattttatttaaacaaaaagttgattccctagttcccttcagtcttgtctagattttcaggatacagttagtttctcatttggtgctaccttatgagagaatttgatagaaaatggcctactcaataaaaagtcaaactttcttttttttttttttgagacagagtctcactctgtcgcccaggctggagtacagtggtgtgatcccagctcactgcaagctctgccccctgggttcatgccattctcctgactcagcctctcgagtagctgggactacaggtgcccgccaccacacccggctaattttttgtatttttagtagagatggggtttcaccgccaggatggtctcaatctcctgacctcgtgatccatcctcctgacctcgtgatccatccgcctcagcctcccaaagtgctgggattacagacatgagccaccgctcccggcctcaaactttcttttctaaaaactcattcaatcagagaatattagacagatagacatagagtattagacagatagaatattagacagaacttcctcataggaagacactctctgttgaac

SEQ ID NO: 1805 - DNA, 8105 bp, Homo sapiens
tggttaattgggaaaagtaaccatctaatccagtttatttttttctaattttaatttttgtttttctttcaatagttttagagaaacaggtggggtttactgcatggaaaagtaatttagtggtgatttccaagattttggtgtacccattacctaagcagtgtacttgggtacactgtacccaatgtgtagtcttttttccttcaccctctgccctcttgatgcctctccatccttgtagcttggttcccacttataaatgataacatacaatgtttggttttccattcctgagttacttcacttagaataatggtctccaaccccatccaggttactgtgaatgccattatctcattccttttatggctgagtagtattccatggtgtgtgtgtgtgtgtgtgtgtgtgtgtgtgtgtgtgtgtgtatcacattttctttatccactcgttggttgatgggcatttaggctggttcacagttttgcagttataaattgtgctgctatagacatgcatgtgcaagtgtctttttcatataatgacatcttttcctctaggaagataaccagtagtgggattgctggatcaaatgatagttctacttttagttctttaagaaatcttcatactgttttccataatgattgtactagtctacatccccaccagcagtgtaaaactgttcccttttcaccacatccatgtcaacatctggtactttttaaatatggccattcttgcagtagtaaggtggtatctcattgtggttttgatttgcatttccctgatcattactgatgtagagcattttctcatatgtttgttggtcttttccatatcttcttttgagaattatctattcatatccttagcccaccttttgatgggattacttgttttcttcttgctgatttgttttcattccctgtagattttggatattagtcctttgtcgaatgtatagactgcaaagattttctcccactctgtgggttgtctgtttactctgctgattatttcttttgctatgcagaagctttttagtttaattaagttccatctatttatctttgtttttgttgcatttgcttttgggttcttggtcatgaggtctttgcctaagccaatgtctagaagtgtttttccaatgttatctcctagaatttttatggtttcaggtcttagattgaagtctttgatccatcttgagtggatttttatatacgatgagagatgaggatccagtttcattcttctacatgtggcttgccgattatcccagaaccatttgttgaatagggtgtcctttccccaccttatgttgttgttcgctttgtcaaagatcagttgactttaagtatttggctttatttctgggttctctgttctgctcctttggtctatatgagccctacctaactttttaattccaatttggatgccctttcttttttcacttgtctgattgctctaagtaggacttccaaaactatgttgactagaagtggtggaaatgggcatccttgtcttgtttcaattctcaaggggagtgctttcaacttttccccattcagtataatgtttgctgttgatttgtcatacacagtttttattaccttaaggtatgtcccttctgtgctaattttgctgagagttttaatcataaatgagtgctggattttgtcagatgctttttctccatctattgagatgatcatgtgatttttgtttttaattctgtttatgtgatatatcacagttttttttttttttctaagatggagtctcactctgtcacccaggctggagtgcagtggcatgatcttggctcactgcaacctctgcctcccaggttcaagctattctcctgcctcagcctctggagtagctgggactacagatgtgcaccacaatgcccggctaatttttttgtatatgttttttgtagtgacagggttttgccatgttggccaggctgatcttgaactcctgacctcatgatccaccctctcagcctctcaaagtgctgggattacaggcgtgagcctccacacccaacctgtatcacatttattgacttgcagatgttaaaccatccctgcatcctggtatgaaaaccacttgattatggtgtatgatccatttgatatgctcttagatattgttagctagtattttgtggaggatttttgcatctatgttcatcagggatattggtctgtagttttctttttttgttatgtcctttctgggttttggtaaatcccagaatgatttagggaggattccgtctttctctatcttttggaatactgtcaataggactggtaccaattctttgaatgtctgatagaattcagctgtgaggccatctggtcctggacttttttttgttggtaactttttaattactctttcaatttcgctgcttgttattggtctgttcagagtttctatttattcctgatttaatctagaagggttgtatatttcttggaatttatccatctcctctacattttctagtttgtccacataatggtgttcagaacagtcttgaatgatcttttgtatttccgtggtatcagttgtaatagctcccatttcgtttctaattgagctcatttggatcttctctcttcctttcttggttagtctcacagtctatcaattttgtttatctttcaaataaccaggttttgtttcatttctcttttgtatttttttgttttgatttcatttggttctgctctgatctttgttacttattttttctgttaggtttgggttggtttttctttgtttctctagttccttcaggtgtgactttagattgcctatttatgctctttcagactttttgatgtaagcatttaatgctatgaactttcctcatagcactgcttttgctgtgtcccagaggttttgacaagctgtgtcactactattgttcagttcaaagaattttttaatttccatcttgatttcattgttgacctaaagatcattcaggggcagattattgaatttccaagtatttgtatagttttgagggttccttttggagttaatttccaattttatttcactgtggtctgagagggtacttgatattattttgattttcttaaattaatattgagacttgttttgtggcctatcctatggtctatcttggagaatgttccatgtgctgatgagtagaatgtatattctgcggttttggggtagaatgttctgtaaatatttgttaagtccatttgttctgggtatagtttaaatccattgtttccttgttgactttctgtcttgatgacctctctagtgctgtcagtgaagcattgaagtcccccactattattgtgttgccatctatctcatttcttaggtctagtaataattattttataaatttgggagctccagtgttgggtgcatatatatttaggattatgatattttcttgttggatggatctttttatcattacataatgtctccctttgtctttttcaactgttgttgttttaaagtctgttttgtctgatataagaatagctactcctgctcacttttggtttccattttcatggggtatctttttccaccccattaccttaagtgagttcttatgcgttaagtgaatctcttgaagagagcagatacttggtgggtggatttttatccatgctgccattctgtattttttaagtgagcatttaggtcatttacattcaacataagtactgagatgtgaggtactgttttattcatcgtgctagctgttgcctgaacatcttgggttttttctttttgttagtgtttaataggccctgtgagatttacactttaacgaggttctattttggtgtatttcgaggttttgtttcaggatttagatctcgttttagcatttcttgtggtgctgacttggtagtgatgaattcactcaacatttgtttgtctgaaagatgaccttatctctccttcatttatgaagctcagttttgctggatacaaaattcttggctgaaatatactgtgtttgaggaggctaaggatagaccccaattcacttctggcttatagggtttctgctgagaaatctgctgttaatctgataggttttcctttataggttacctgatgctttcgcctcacagctcttgagattctttcctttgttcttgactttatataacctgatgacaactatgtgactgggtaatgatctttttgtgatgaatttaccaggtgttttttgagcttcttgtatttggatgtttagttctctggtgaggccaggcaaggtttcctcaattatgtttcccaaacttttagatttatcttcttcctcaggaacaccaattattcttgggtttggttaacataatcacaaatttcttggaggctttgttcatttttttttctttgtcttttttggattaggttacttcgaaagccttgtcttcaagctctgacattctttttcctactcattcaacatcattgttgaaactttctggtgcattttgtatttctctaagcgtgtctttcacttccagaagttgtgattgttttttctttacaatatctatttctctgtagcatttttcatccatatcctgtattgttttttaaatttgtttaaattggttttcccctttctctggtatctccttgagtaacttaattatcaaccttctaaattctttatctggcaattcagagatttttttttattggtttgaatcaattgctatgaagctagtgtggtctcttaggggtgttgtaaaacctcatcttgtcatattttctgattccttctcatttgggtagactatttcagtggaaaaatctggaactcaagggctgctatttagattcttttgtcccatggggtggtcccttgatgtggtacactgccccttcccctagggatgaggcttgctgcaagccagactgcagtgactggtattgctcttctgagtctagccaccgagtacggctaccaggctccgagctggtgctggggaatgtctacaaacagtcctgtgatgcgatccaccttcaggtctcccagccatggataccagcgcctgccctgttggaggtggcaggggcgtgaaatagactctgtgagagtccttggttgtagatatgtttagtgtgctggctttctcaaatgctggttatgctagcagtgacactgtcacgtggacagatttaggaccactggttagccaggatgttgcagggcacacggaattagctgttgttttcctcttccttggagcagcgttattctgtcattgagttgctgcaacgtcctgagttggtcagactacaggcagaaggtggtgctttcaagagagcaccagctgtgatagaagaggggggatataagcttgccctaagttgaccaagataagtgttcaggtttctcaagtaatgggcggggtcataaagctcccaaaagtttatgtctttcatgatccactactgggtatagagaaatactgtcaagtcagggcagggttaggcagatctgagctcagactccccttgggtggggcttgctgcagccactgtgggggtgtgggaggggtggttctcgggttaaattccaaaggggattatggctgcctctgttgccaggaaagtgagggaaagccagtagcgataggccccacccagcttttacccagttggtgaggcctgtctcactcccactgtgccatctaaaaccactgagtttgtctccaggcagcctgcacatgggactcagacctagccccaagttataagtttcccagctgagaaagcaagcagggctttcaggttacacccctccccatctgcccacattgtcccccatgactcctcctctcctttctgccgcagttcctgcttgcccccacattctgctcaagagagtttgtgcccagtcaaaattattgtaaaaatcacaattacttttgcgtagtatctaaacattttttaatatagtataataatatgaatttgatcagctcaagaaacttctaatgattttaactgtttaatccaaataaccatttacttcaaaggactcatcacaattatacttatttaatatcttacttgtttaatgtagtagacaatgagctccatgaaaacaaggtgtacatctctctcatcactaaaaccccagagcctaatgtggtgtctctttgatagtgggagatcaaatgtattttttcaaatgaaagaaatttaatgaagaactgttcattccatgccagatttggctgaattagaactggtccctgcattcaagaagctcacagtctgctgagggagagcaacatgtaatcaataaacaatagtacaatataataagtgctgtgccagaaatataaacaaataccatagaaacataagggaagaagtgattaattctgcttaaaggtagaaaatattaagaagtttttgaccaagtaataaatactcatttccttgggatggatgtttatactaagaaataatgtctatatcacattctattaacttgattagttccacagttcagtaaaacatattctatattgaaaaatttttttagatattactacgctatttcaggacatcttgaaagggcttattcctaaaataatcttttagaattttttttatattctctctctctctctctctatatatatatatataaattccctgaaagtagttcaacaacaaaaagtaaaattcaaggctataatattaataatactagtttgcttgctataggaaaacctagatgagaaagcctattgcttttttgccagctaccacatattagttacagtgatcatcaccaaattttcacttattatgtacttaacagaaatcaccagatcctttcacactcccaacaatagctttggggtttcactatctcactatatagggaaatctcatatgcactcaaaataaaagatttttttcctatattagctacagcacaaataatagcatccttcatttagaaacaaccagcctcatactcatctaaagcacataaatttagttaaatggtgccatctggtgacataaatcttgcagtaaatataaaagtcctgagtcagagtccagaatgatacccaaccctcttgatggcatccaatccaaagtgtctaatttaacttaagaaatacttgatcctgcctgacatgaaacacacaactaatcacactcagtatatggccgtttaacaaagggaattataacaattgtttgagccacattttatgctcaccactcttgtttctcaactctttggaagagacttgtatctaacaggatgccctatacaactcctagaagacattttaaaagcataaatatcaaggacattttgaatccctgttccaggcagatccatttcctcactctcctttgaacgtacatcaatgtgtataattttcaacacttcaaaatgtcacttccttaagaaagctgtcgaccaggtgtggtggctcacgcctgtaatcccagcgctttgggaggccaaggcaggcaaatcacaagctcaggagttcaagaccagcctggtcaacatggtgaaaccccgtctctactaaaaaaaaatacaaaaattagctgggcgtggtggcacatgcctgtagtcccagttactcaggaggctgaggcagaagaatcccttgaatgggaggtggaggttgcagtgagccaaagatcaagccactgcactccagcctgggtgacagagctagacttcatctcaaaaaaagaaggagaaagctgtccctgtttctactgttaaggttaagcctctcattcatagccaactctacttcttctttgtatataaactcttgacgaaattttgtttaatgcttgtctccccagtgtgtatcatagcgtttggcaaagtgttcaataaatatcctgtgaacgaattaatgtgtaaatggatggtgaaaacatccttctctactctctcttctaatgcaaatcctattaataacaaggctcagctcaagtttacattttatataaaaccttctctagcaacaacaatgtacaataagcccatgctt

SEQ ID NO: 1806 - DNA, 1667 bp, Homo sapiens
agaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggt
